(12) United States Patent
Ferrara Koller et al.

(10) Patent No.: US 11,447,558 B2
(45) Date of Patent: Sep. 20, 2022

(54) BISPECIFIC ANTIGEN BINDING MOLECULES COMPRISING ANTI-4-1BB CLONE 20H4.9

(71) Applicant: Hoffmann-La Roche Inc., Little Falls, NJ (US)

(72) Inventors: Claudia Ferrara Koller, Schlieren (CH); Christina Claus, Schlieren (CH); Christian Klein, Schlieren (CH); Pablo Umaña, Schlieren (CH); Wei Xu, Schlieren (CH)

(73) Assignee: Hoffmann-La Roche Inc., Little Falls, NJ (US)

( * ) Notice: Subject to any disclaimer, the term of this patent is extended or adjusted under 35 U.S.C. 154(b) by 86 days.

(21) Appl. No.: 16/446,486

(22) Filed: Jun. 19, 2019

(65) Prior Publication Data

US 2020/0190206 A1 Jun. 18, 2020

Related U.S. Application Data

(63) Continuation of application No. PCT/EP2018/050024, filed on Jan. 2, 2018.

(30) Foreign Application Priority Data

Jan. 3, 2017 (EP) .................................. 17150150
Mar. 31, 2017 (EP) .................................. 17164224

(51) Int. Cl.
*C07K 16/28* (2006.01)
*C07K 16/40* (2006.01)

(52) U.S. Cl.
CPC .......... *C07K 16/2878* (2013.01); *C07K 16/40* (2013.01); *C07K 2317/31* (2013.01); *C07K 2317/35* (2013.01); *C07K 2317/52* (2013.01); *C07K 2317/55* (2013.01); *C07K 2317/565* (2013.01)

(58) Field of Classification Search
CPC .. C07K 16/2878; C07K 16/40; C07K 16/468; C07K 2317/31
See application file for complete search history.

(56) References Cited

U.S. PATENT DOCUMENTS

| | | | |
|---|---|---|---|
| 7,288,638 B2 * | 10/2007 | Jure-Kunkel | A61K 39/12 530/388.15 |
| 9,011,847 B2 | 4/2015 | Bacac et al. | |
| 9,718,893 B2 | 8/2017 | Jung et al. | |
| 10,253,110 B2 | 4/2019 | Bacac et al. | |
| 10,392,445 B2 | 8/2019 | Amann et al. | |
| 10,464,981 B2 | 11/2019 | Amann et al. | |
| 10,526,413 B2 | 1/2020 | Amann et al. | |
| 10,577,429 B2 | 3/2020 | Bacac et al. | |
| 11,149,083 B2 | 10/2021 | Amann et al. | |
| 11,242,396 B2 | 2/2022 | Bruenker et al. | |
| 11,267,903 B2 | 3/2022 | Amann et al. | |
| 2002/0004587 A1 | 1/2002 | Miller et al. | |
| 2014/0370019 A1 * | 12/2014 | Bruenker | A61K 39/39558 424/136.1 |
| 2015/0232567 A1 | 8/2015 | Lazar et al. | |
| 2017/0022287 A1 | 1/2017 | Igawa et al. | |
| 2017/0174786 A1 | 6/2017 | Bacac et al. | |
| 2017/0247467 A1 | 8/2017 | Amann et al. | |
| 2018/0148485 A1 * | 5/2018 | Hinner | C07K 14/47 |
| 2018/0230215 A1 | 8/2018 | Hofer et al. | |
| 2018/0282409 A1 | 10/2018 | Koller et al. | |
| 2018/0340030 A1 | 11/2018 | Bruenker et al. | |
| 2019/0016771 A1 | 1/2019 | Amann et al. | |
| 2019/0185566 A1 | 6/2019 | Koller et al. | |
| 2019/0194291 A1 | 6/2019 | Bruenker et al. | |
| 2019/0211113 A1 | 7/2019 | Amann et al. | |
| 2019/0248877 A1 | 8/2019 | Amann et al. | |
| 2019/0382507 A1 | 12/2019 | Amann et al. | |
| 2020/0071411 A1 | 3/2020 | Amann et al. | |
| 2020/0079873 A1 | 3/2020 | Bacac et al. | |
| 2020/0190207 A1 | 6/2020 | Bruenker | |
| 2020/0231691 A1 | 7/2020 | Grau-Richards et al. | |
| 2020/0247904 A1 | 8/2020 | Amann et al. | |
| 2020/0270321 A1 | 8/2020 | Amann et al. | |
| 2020/0277392 A1 | 9/2020 | Amann et al. | |
| 2020/0317774 A1 | 10/2020 | Hofer et al. | |
| 2020/0325225 A1 | 10/2020 | Bacac et al. | |
| 2020/0325238 A1 | 10/2020 | Bacac et al. | |
| 2020/0347115 A1 | 11/2020 | Duerr et al. | |
| 2020/0392237 A1 | 12/2020 | Bacac et al. | |

(Continued)

FOREIGN PATENT DOCUMENTS

WO 2010/145792 A1 12/2010
WO 2012/020006 A2 2/2012

(Continued)

OTHER PUBLICATIONS

Almagro & Fransson, Frontiers in Bioscience; 13:1619-33 (Year: 2008).*
Baumann, R., et al., "Functional expression of CD134 by neutrophils" Eur J Immunol 34(8):2268-2275 (Aug. 1, 2004).
Broll, K., et al., "CD137 Expression in Tumor Vessel Walls High Correlation With Malignant Tumors" Am J Clin Pathol 115(4):543-549 (Apr. 1, 2001).
Buechele, C., et al., "4-1BB ligand modulates direct and Rituximab-induced NK-cell reactivity in chronic lymphocytic leukemia" Eur J Immunol 42(3):737-748 (Mar. 1, 2012).
Choi, B., et al., "4-1BB Functions as a Survival Factor in Dendritic Cells" J Immunol 182(7):4107-4115 (Apr. 1, 2009).

(Continued)

*Primary Examiner* — Jessica H Roark
(74) *Attorney, Agent, or Firm* — Robin A. Weatherhead

(57) ABSTRACT

The invention relates to new bispecific antigen binding molecules, comprising at least one antigen binding domain capable of specific binding to 4-1BB, at least one moiety capable of specific binding to a target cell antigen, and a Fc domain composed of a first and a second subunit capable of stable association, and to methods of producing these molecules and to methods of using the same.

22 Claims, 30 Drawing Sheets

Specification includes a Sequence Listing.

(56) References Cited

U.S. PATENT DOCUMENTS

| | | |
|---|---|---|
| 2021/0009656 A1 | 1/2021 | Bruenker et al. |
| 2021/0024610 A1 | 1/2021 | Koller et al. |
| 2021/0070882 A1 | 3/2021 | Bacac et al. |
| 2021/0095002 A1 | 4/2021 | Claus et al. |
| 2021/0163617 A1 | 6/2021 | Ferrara Koller et al. |
| 2021/0188992 A1 | 6/2021 | Bruenker et al. |
| 2021/0253724 A1 | 8/2021 | Claus et al. |
| 2021/0292426 A1 | 9/2021 | Duerr et al. |
| 2021/0324108 A1 | 10/2021 | Amann et al. |
| 2022/0025046 A1 | 1/2022 | Amann et al. |
| 2022/0025069 A1 | 1/2022 | Claus et al. |
| 2022/0073646 A1 | 3/2022 | Amann et al. |

FOREIGN PATENT DOCUMENTS

| | | |
|---|---|---|
| WO | 2012/130831 A1 | 10/2012 |
| WO | 2014/116846 A2 | 7/2014 |
| WO | 2016/177802 A1 | 11/2016 |
| WO | 2016/184882 A1 | 11/2016 |
| WO | 2017/060144 A1 | 4/2017 |
| WO | 2019/086500 A2 | 5/2019 |
| WO | 2020/007817 A1 | 1/2020 |
| WO | 2020/208049 A1 | 10/2020 |
| WO | 2020/260329 A1 | 12/2020 |
| WO | 2021/140130 A1 | 7/2021 |
| WO | 2021/198335 A1 | 10/2021 |

OTHER PUBLICATIONS

Croft, M. et al., "The sifnificance of OX40 and OX40L to T-cell biology and immune disease" Immunol Rev 229(1):173-191 (May 1, 2009).

Diehl, L., et al., "In Vivo Triggering Through 4-1BB Enables Th-Independent Priming of CTL in the Presence of an Intact CD28 Costimulatory Pathway" J Immunol 168(8):3755-3762 (Apr. 15, 2002).

Dubrot, J., et al., "Treatment with anti-CD137 mAbs causes intense accumulations of liver T cells without selective antitumor immunotherapeutic effects in this organ" Cancer Immunol Immun 59(8):1223-1233 (Aug. 1, 2010).

Futagawa, T., et al., "Expression and function of 4-1 BB and 4-1BB ligand on murine dendritic cells" Int Immunol 14(3):275-286 (Mar. 1, 2002).

Gunasekaran, K. et al., "Enhancing Antibody Fc Heterodimer Formation through Electrostatic Steering Effects: Applications to Bi-Specific Molecules and Monovalent IgG" J Biol Chem 285(25):19637-19646 (Jun. 18, 2010).

Heinisch, I., et al., "CD137 activation abrogates granulocytemacrophage colony-stimulating factor-mediated anti-apoptosis in neutrophils" Eur J Immunol 30(12):3441-3446 (Dec. 1, 2000).

Hinner, M. et al., "Costimulatory T cell engagement via novel bispecific anti-CD137/anti-HER2 protein based on Anticalin® technology" J Immunother Cancer 3( Suppl 2):P187 (Sep. 18, 2015).

"International Preliminary Report on Pataentability—PCT/EP2018/050024":pp. 1-10 (dated Jul. 18, 2019).

"International Search Report—PCT/EP2018/050024":pp. 1-6 (dated May 16, 2018).

Kienzle, G., et al., "CD137 (ILA/4-1BB), expressed by primary human monocytes, induces monocyte activation and apoptosis of B lymphocytes" Int Immunol 12(1):73-82 (Jan. 1, 2000).

Kim, D., et al., "4-1BB Engagement Costimulates NKT Cell Activation and Exacerbates NKT Cell Ligand-Induced Airway Hyperresponsiveness and Inflammation" J Immunol 18(4):2062-2068 (Feb. 1, 2008).

Kwon, B., et al., "cDNA sequences of two inducible T-cell genes" PNAS USA 86(6):1963-1967 (Mar. 1, 1989).

Li, F., et al., "Inhibitory Fcγ Receptor Engagement Drives Adjuvant and Anti-Tumor Activities of Agonistic CD40 Antibodies" Science 333(6045):1030-1034 (Aug. 19, 2011).

Lin, W., et al., "Fc-dependent expression of CD137 on human NK cells: insights into agnostic effects of anti-CD137 monoclonal antibodies" Blood 112(3):699-707 (Aug. 1, 2008).

Melero, I. et al., "Monoclonal Antibodies Against the 4-1BB T-cell Activation Molecule Eradicate Established Tumors" Nat Med 3(6):682-685 (Jun. 1, 1997).

Melero, I. et al., "NK1.1 Cells Express 4-1BB (CDw137) Costimulatory Molecule and are Required for Tumor Immunity Elicited by Anti-4-1BB Monoclonal Antibodies" Cell Immunol 190(2 Suppl CI981396):167-172 (Dec. 15, 1998).

Merchant, A., et al., "An efficient route to human bispecific IgG" Nat Biotechnol 16(7):677-681 (Jul. 1, 1998).

Murillo, O., et al., "In vivo depletion of DC impairs the anti-tumor effect of agonistic anti-CD137 mAb" Eur J Immunol 39(9):2424-2436 (Sep. 1, 2009).

Narazaki, H., et al., "CD137 agonist antibody prevents cancer recurrence: contribution of CD137 on both hematopoietic and nonhemotopoietic cells" Blood 115(10):1941-1948 (Mar. 11, 2010).

Nishimoto, H., et al., "Costimulation of mast cells by 4-1BB, a member of the tumor necrosis factor receptor superfamily, with the high-affinity IgE receptor" Blood 106(13):4241-4248 (Dec. 15, 2005).

Olofsson, P., et al., "CD137 is Exressed in Human Atherosclerosis and Promotes Development of Plaque Inflammation in Hypercholesterolemic Mice" Circulation 117(10):1292-1301 (Mar. 11, 2008).

Palazon, A., et al., "Agonist Anti-CD137 mAB Act on Tumor Endothelial Cells to Enhance Recruitment of Activated T Lymphocytes" Cancer Res 71:801-811 (Feb. 1, 2011).

Pieris Pharmaceuticals, Inc. et al., "Pieris Pharmaceuticals Presents Positive Data for its Lead Bispecific Drug Candidate, PRS-343, at the 2016 CRI-CIMT-EATI-AACR International Cancer 1mmunotherapy Conference: Novel 4-1 BB/HER2 Bispecific Demonstrates Differentiation Over Conventional 4-1 BB mAB and HER2 mAb Approaches" Corporate Communications:1-3 (Sep. 26, 2016) https://ir.pieris.com/press-detail/543/pieris-pharmaceuticals-presents-positive-date-for-its-lead.

Schwarz, H., et al., "ILA, the Human 4-1BB Homologue, is Iducible in Lymphoid and Other Cell Lineages" Blood 85(4):1043-1052 (Feb. 15, 1995).

Simeone, E. et al., "Immunomodulating antibodies in the treatment of metastatic melanoma: The experience with anti- CTLA-4, anti-CD137, and anti-PD1" J Immunotoxcity 9(3):241-247 (Jul. 1, 2012).

Snell, L., et al., "T-cell intrinsic effects of GITR and 4-1BB during viral infection and cancer immunotherapy" Immunol Rev 244(1):197-217 (Nov. 1, 2011).

Song, J. et al., "Activation of NF-kB1 by OX40 Contributes to Antigen-Driven T Cell Expansion and Survival" J Immunol 180(11):7240-7248 (Jun. 1, 2008).

Stagg, J., et al., "Anti-ErbB-2 mAb therapy requires type I and II interferons and synergizes with anti-PD-1 or anti-CD137 mAb therapy" PNAS USA 108(17):7142-7147 (Apr. 26, 2011).

Teng, M., et al., "CD1d-Based Combination Therapy Eradicates Established Tumors in Mice" J Immunol 183(3):1911-1920 (Aug. 1, 2009).

Von Kempis, J., et al., "Differentiation-dependent and stimulus-specific expression of ILA, the human 4-1BB-homologue, in cells of mesenchymal origin" Steoarthr Cartilage 5(6):394-406 (Nov. 1, 1997).

Warrs, T., "TNF/TNFR family members in costimulation of T cell responses" Annu Rev Immunol 23:23-68 (Sep. 2005).

Weinberg, A., et al., "Engagement of the OX-40 Receptor in Vivo Enhances Antitumor Immunity" J Immunol 164(4):2160-2169 (Feb. 15, 2000).

Wilcox, R., et al., "Cutting Edge: Expression of Functional CD137 Receptor by Dendritic Cells" J Immunol 168(9):4262-4267 (May 1, 2002).

Wilcox, R., et al., "Ligation of CD137 receptor prevents and reverses established anergy of CD8+ cytolytic T lymphocytes in vivo" Blood 103(1):177-184 (Jan. 1, 2004).

(56) References Cited

OTHER PUBLICATIONS

Zhang, X., et al., "CD137 Promotes Proliferation and Survival of Human B Cells" J Immunol 184(2):787-795 (Jan. 15, 2010).

* cited by examiner

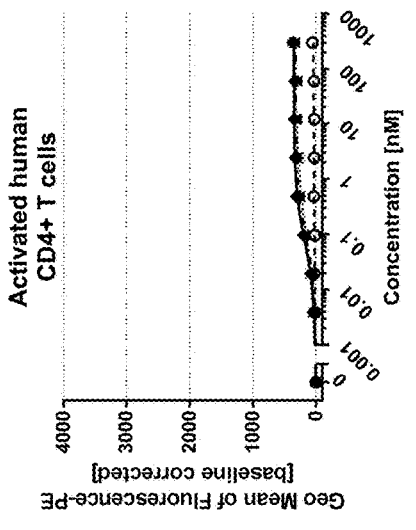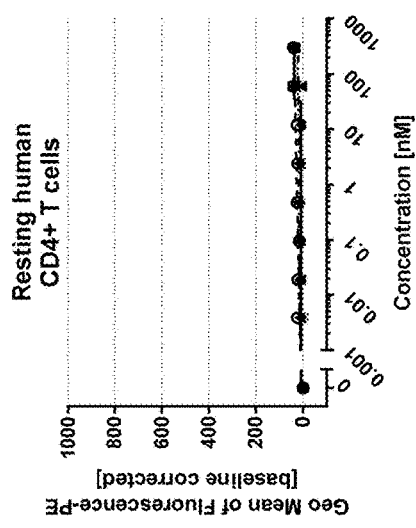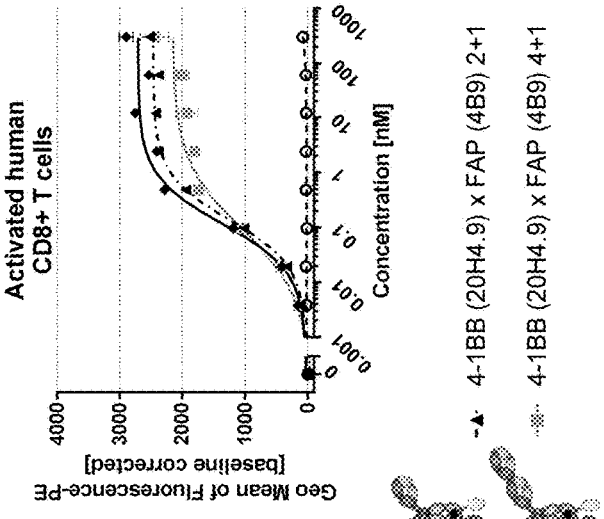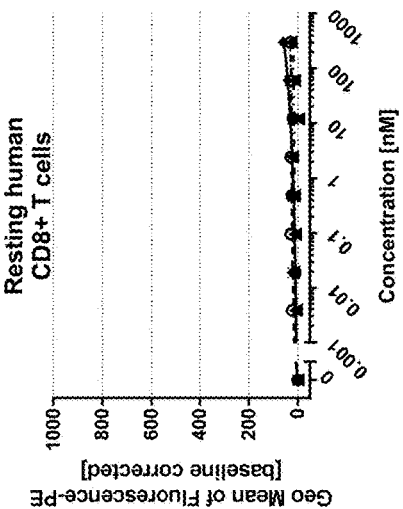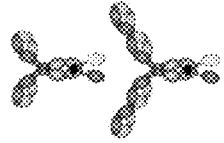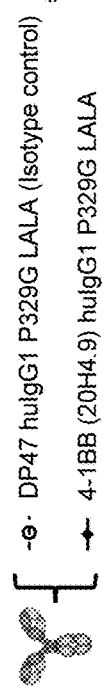

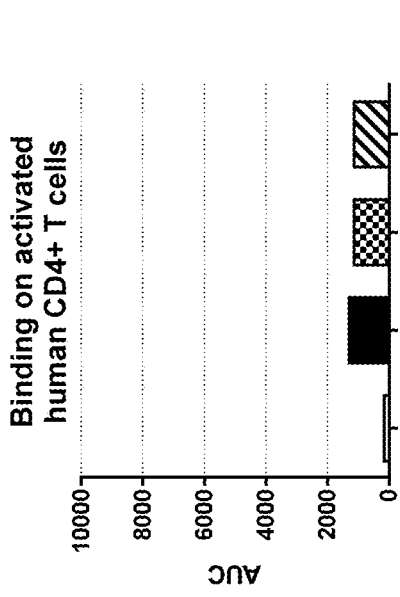
Fig. 8A
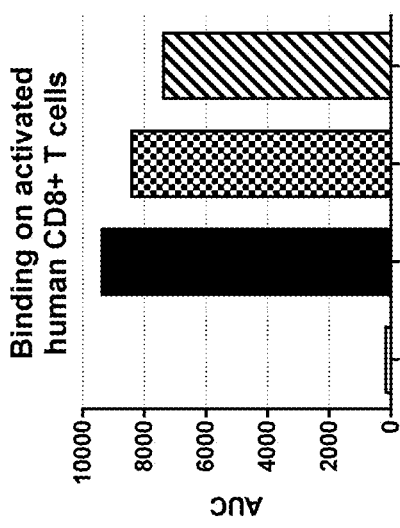
Fig. 8B
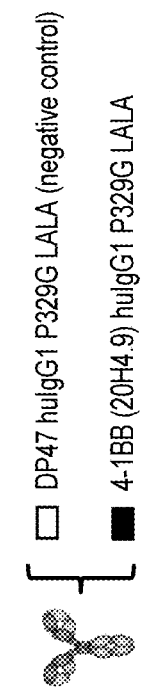

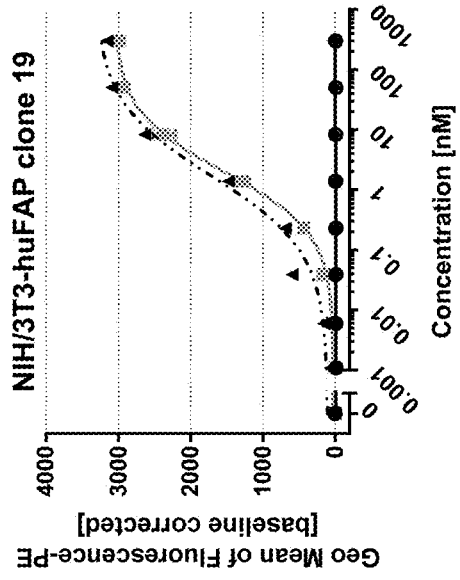
Fig. 9A
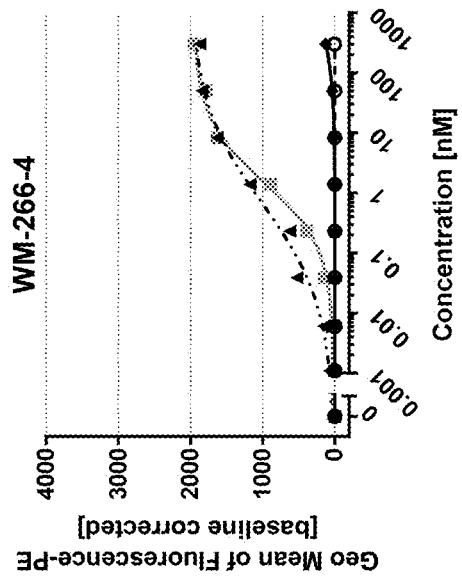
Fig. 9B
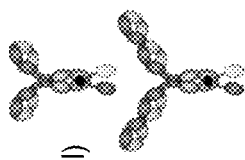

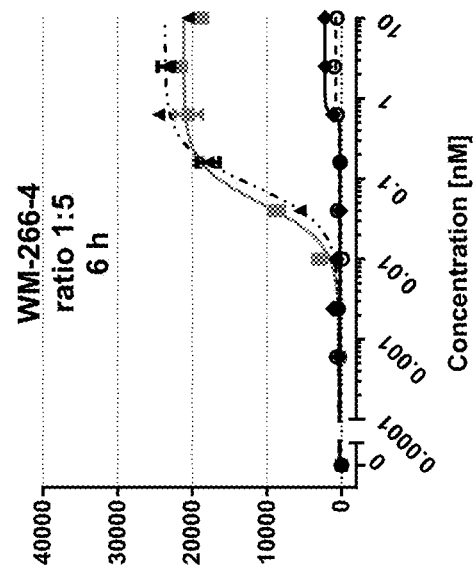
Fig. 10A
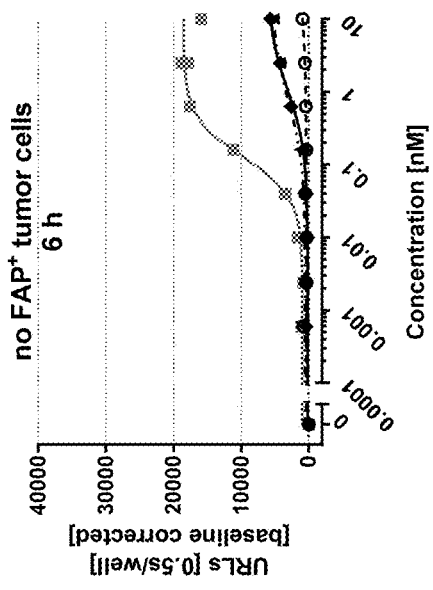
Fig. 10C
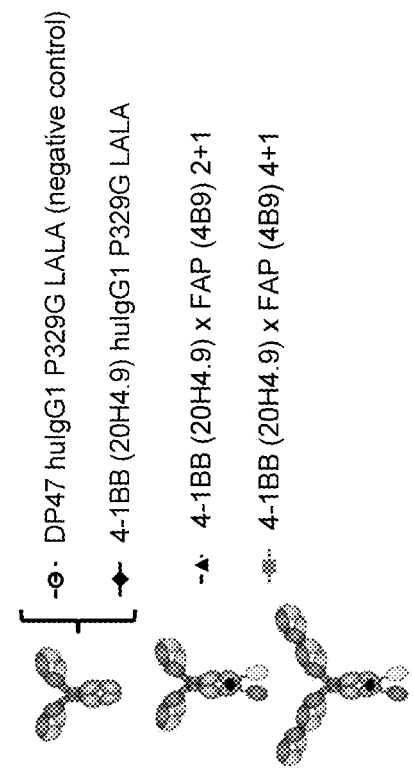
Fig. 10B
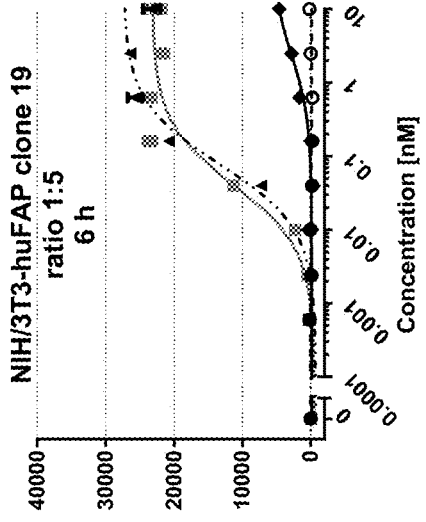

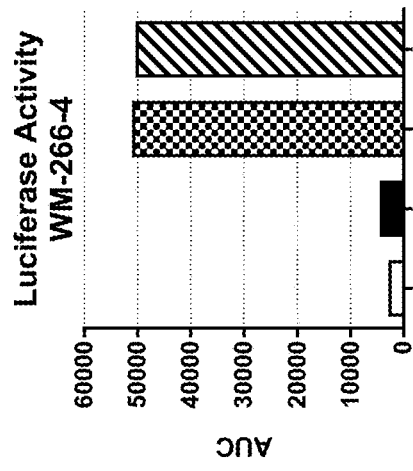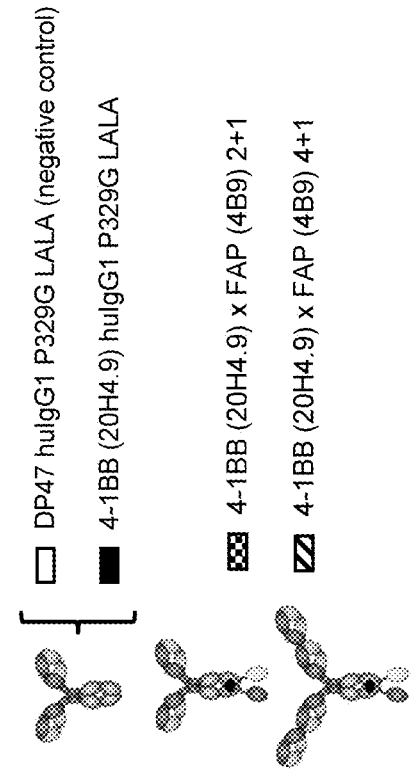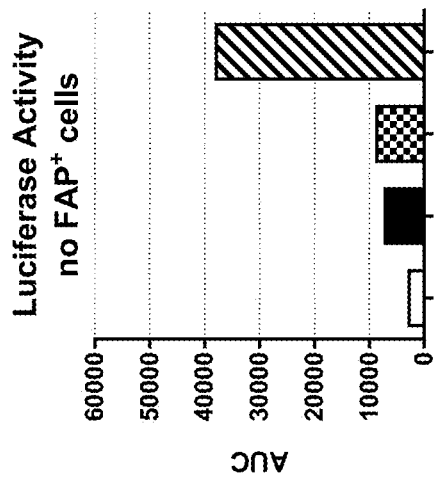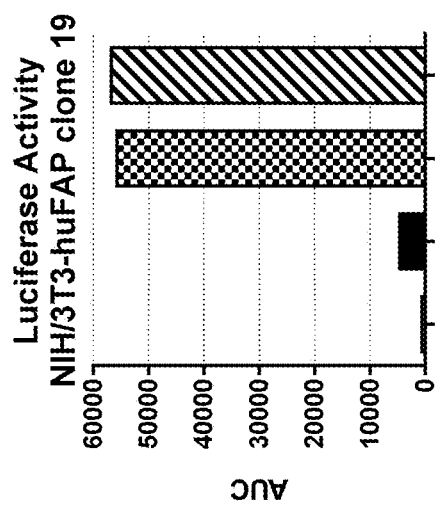
Fig. 11A, Fig. 11B, Fig. 11C

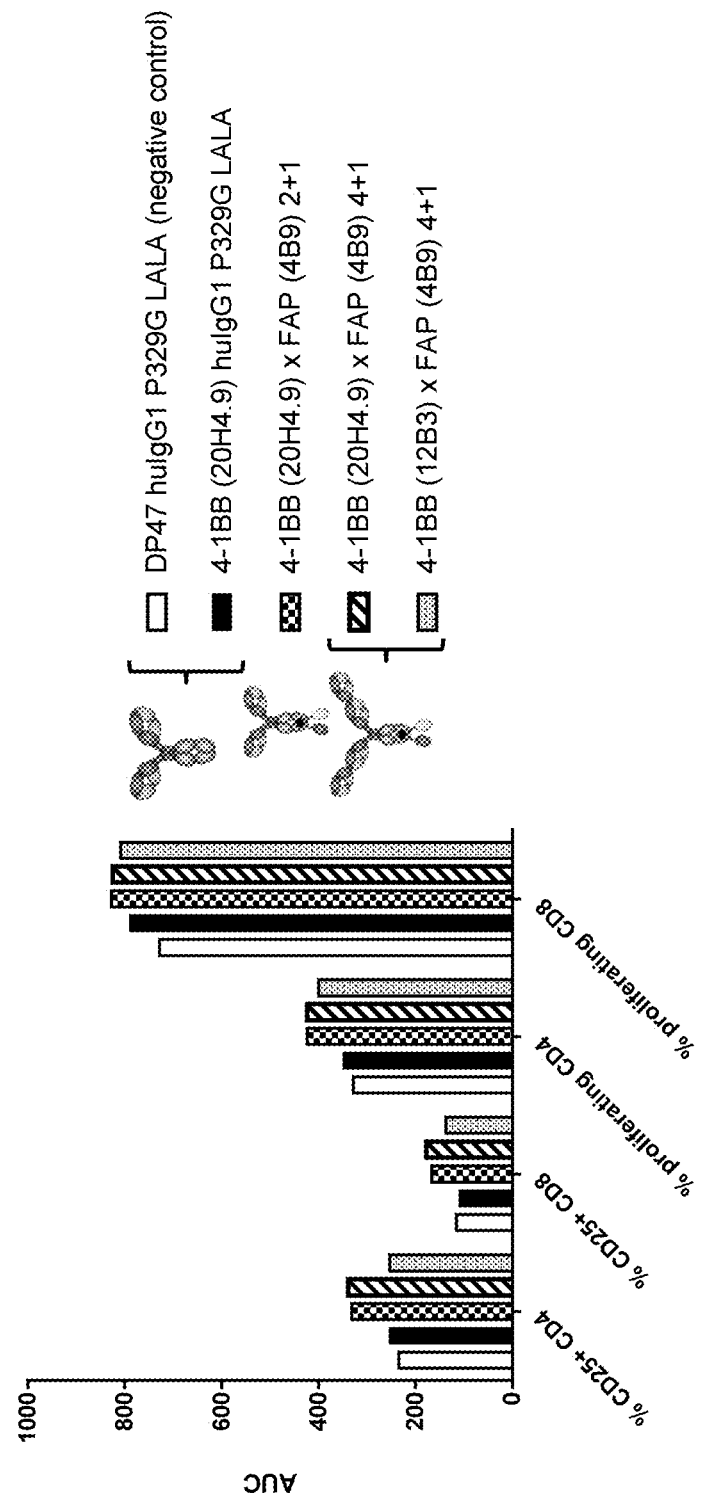

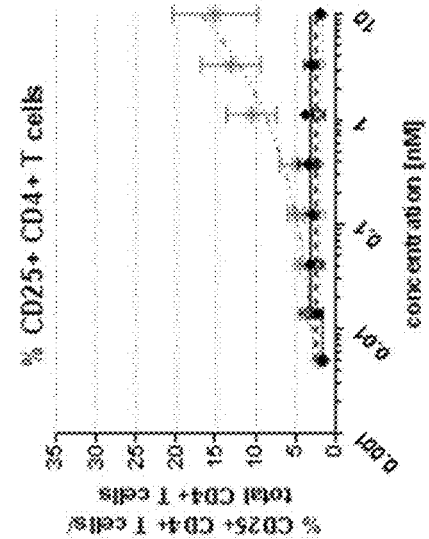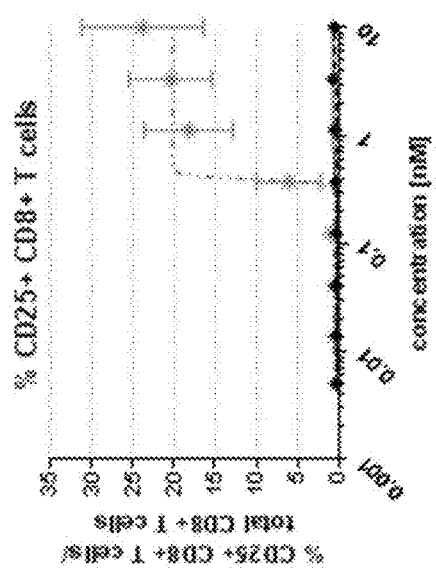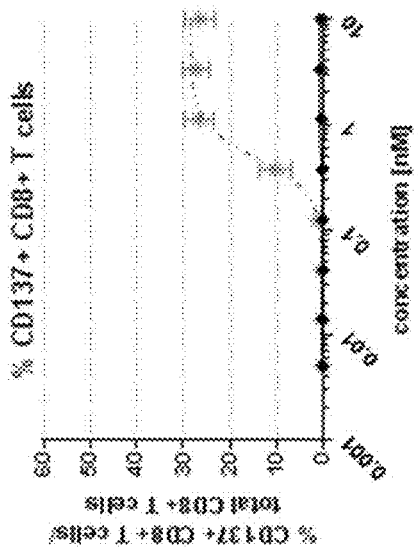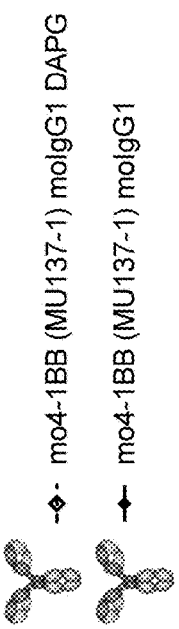

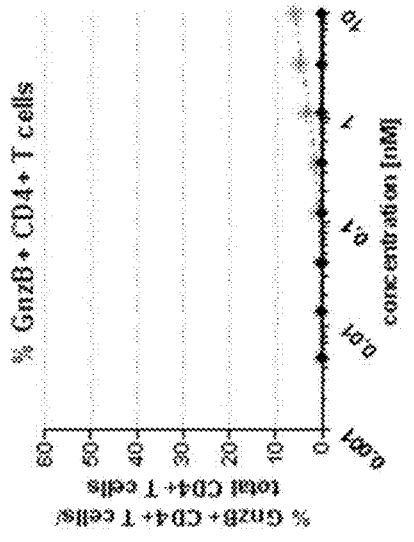
Fig. 14F
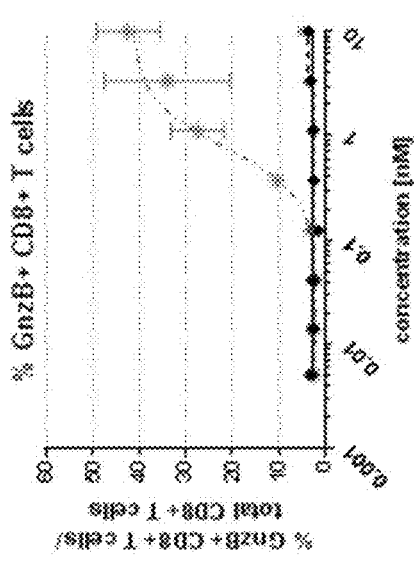
Fig. 14E
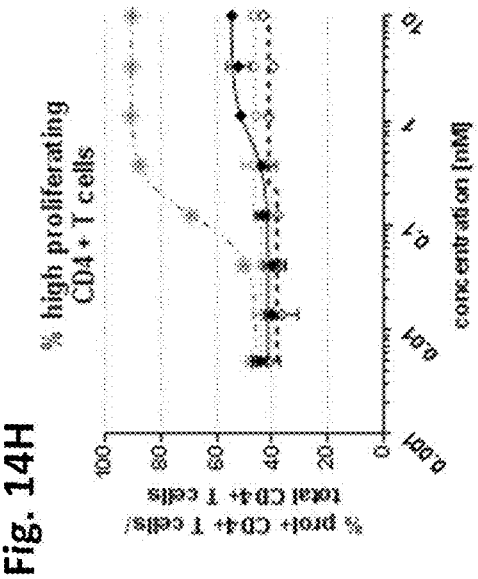
Fig. 14H
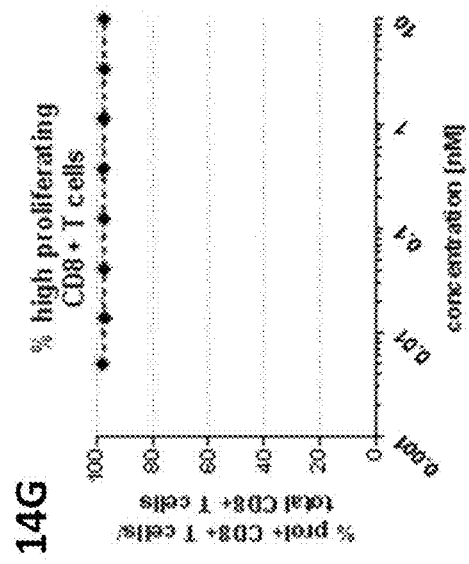
Fig. 14G
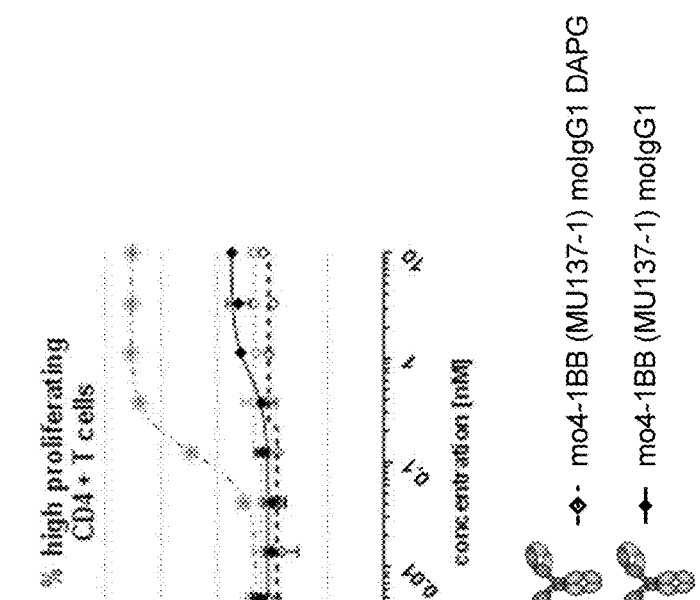

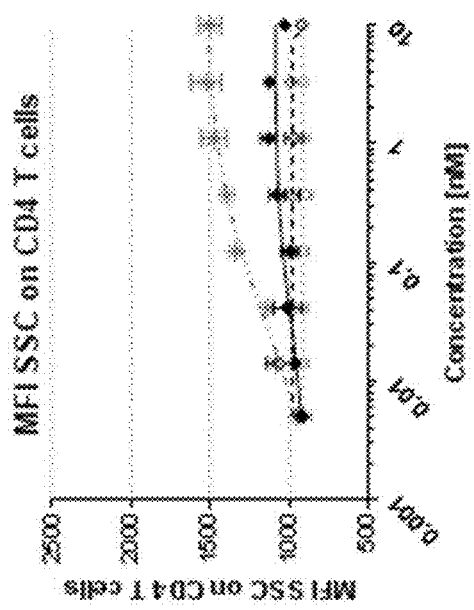
Fig. 14J
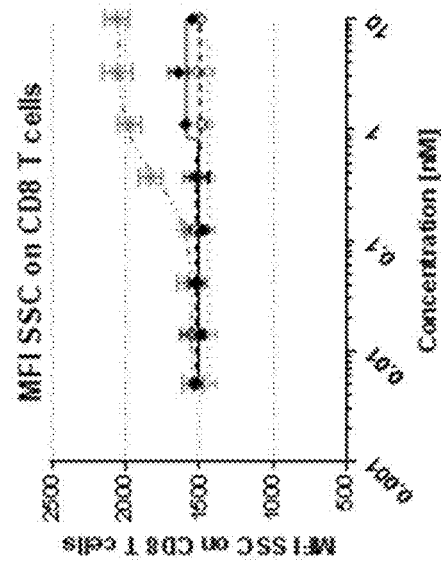
Fig. 14I

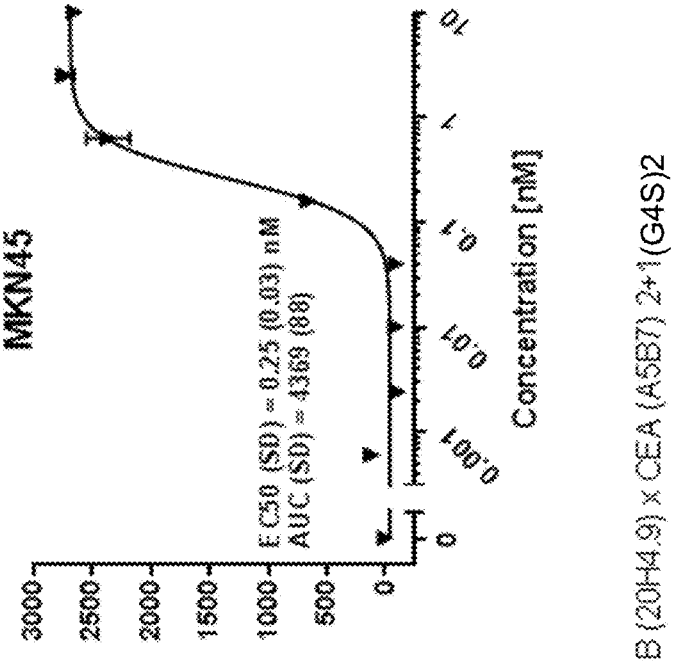
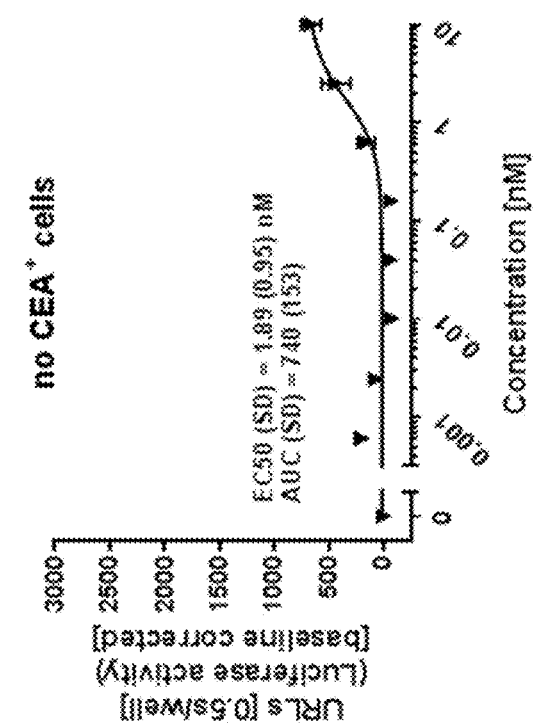
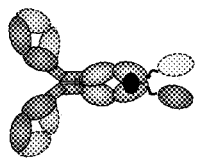
Fig. 15A
Fig. 15B

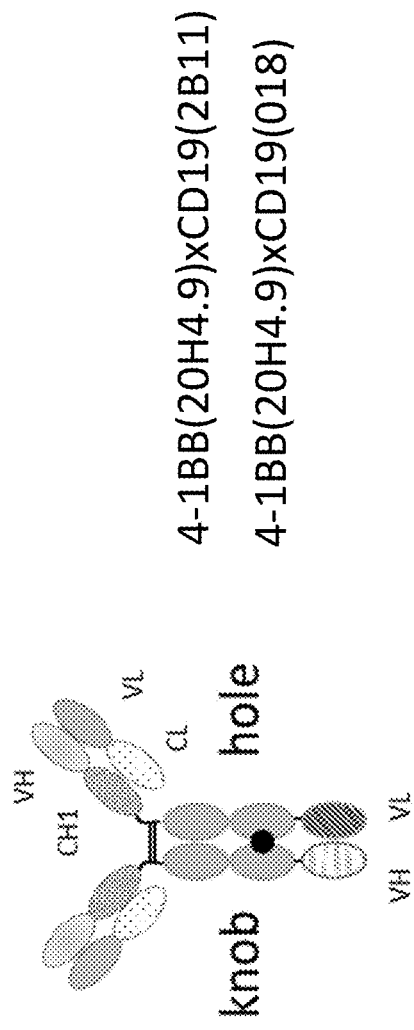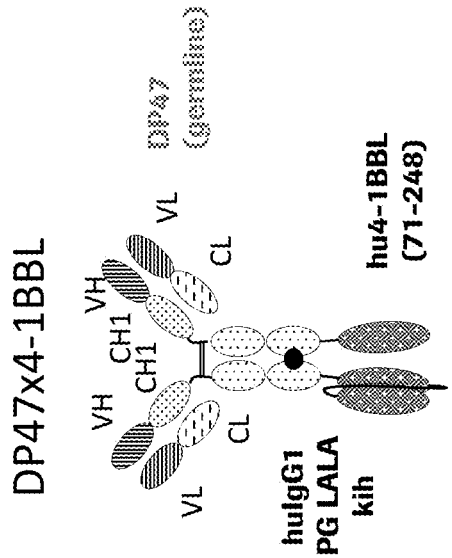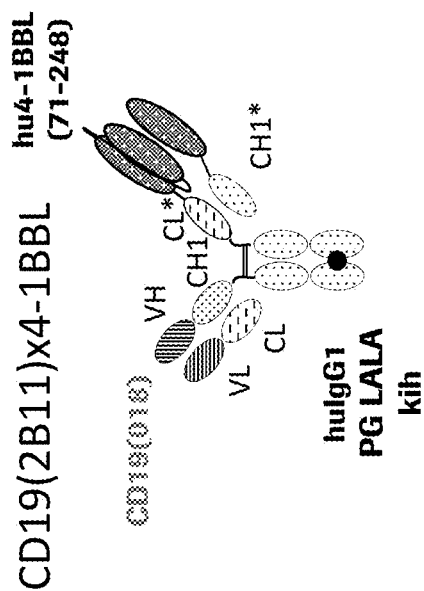
Fig. 16A
Fig. 16B
Fig. 16C
4-1BB(20H4.9)xCD19(2B11)
4-1BB(20H4.9)xCD19(018)

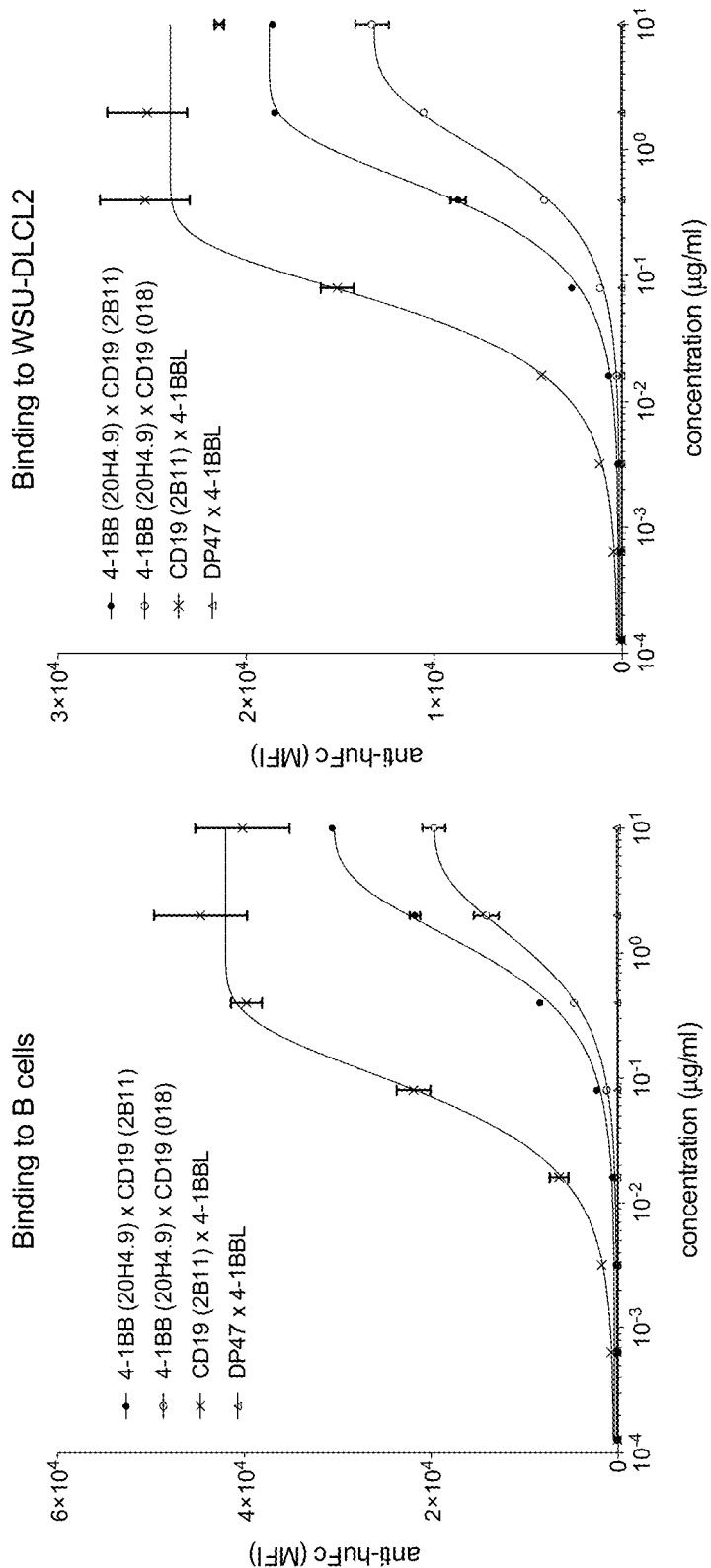

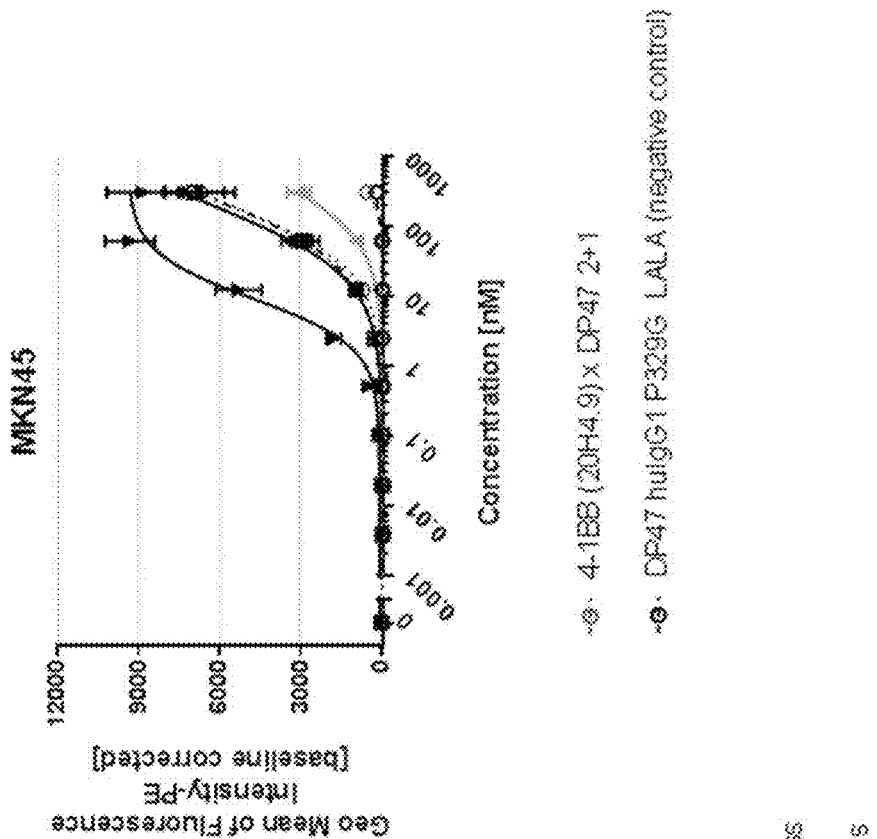
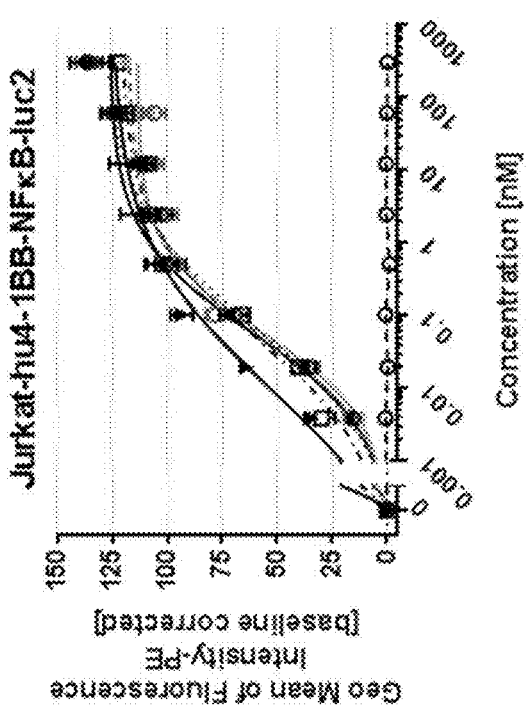
Fig. 21A
Fig. 21B

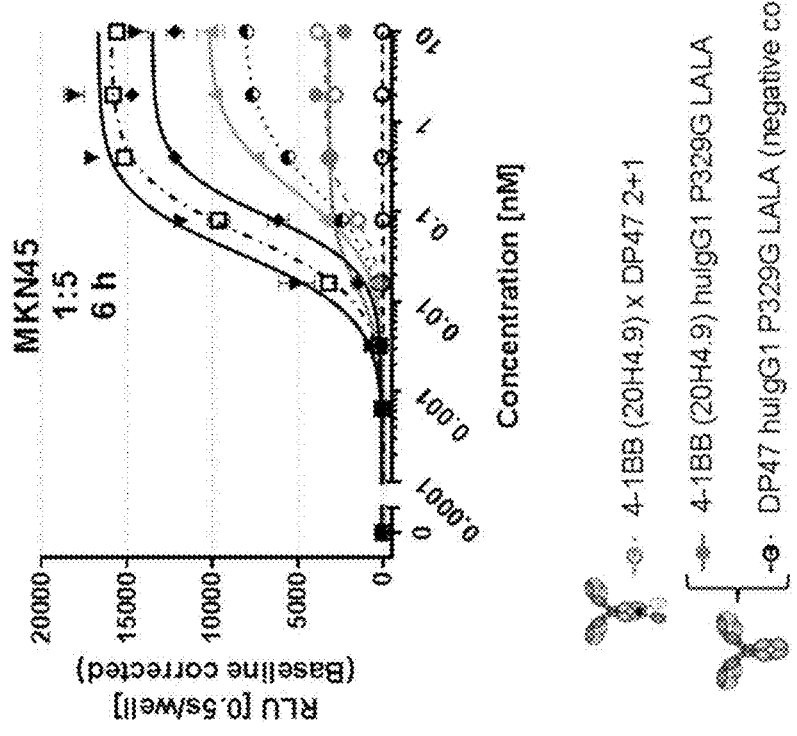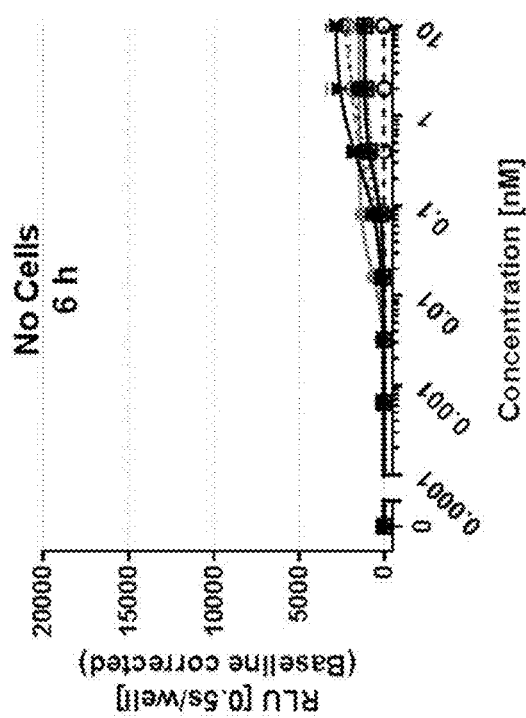
Fig. 22A
Fig. 22B

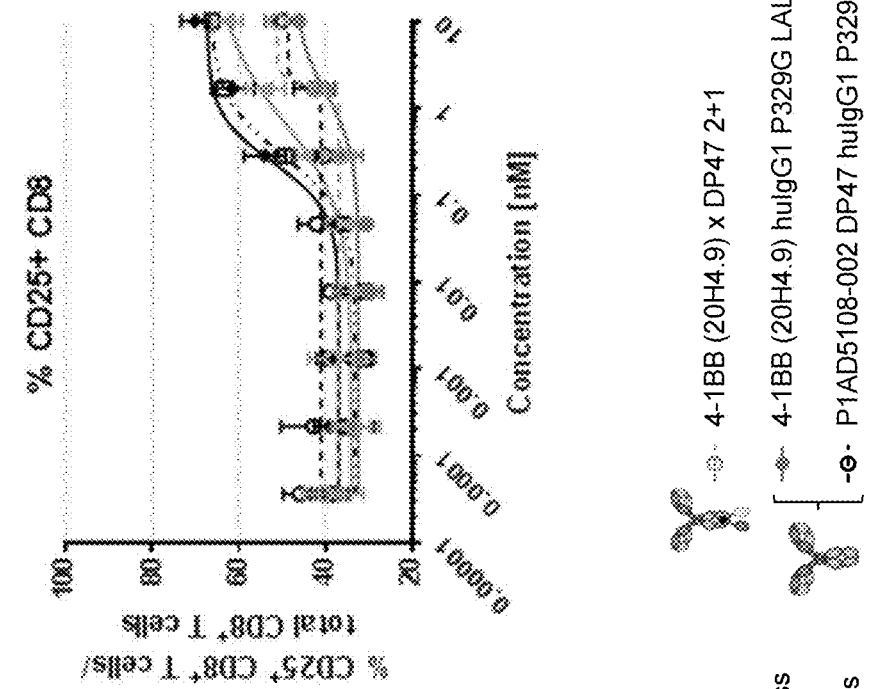
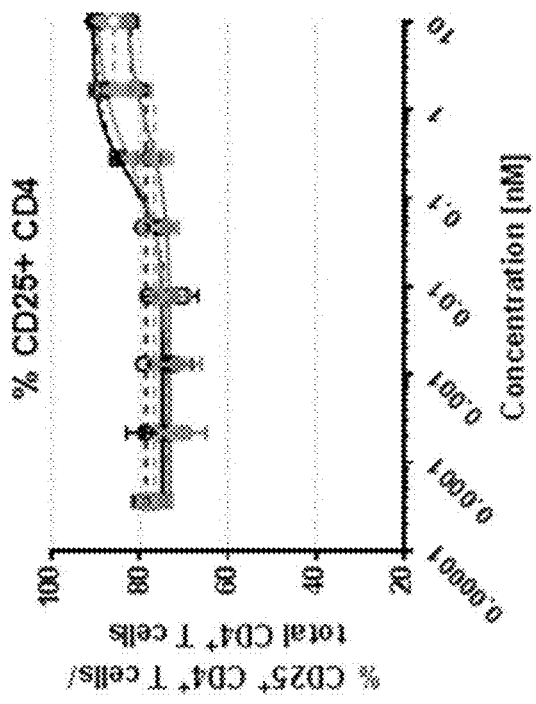
Fig. 24A
Fig. 24B

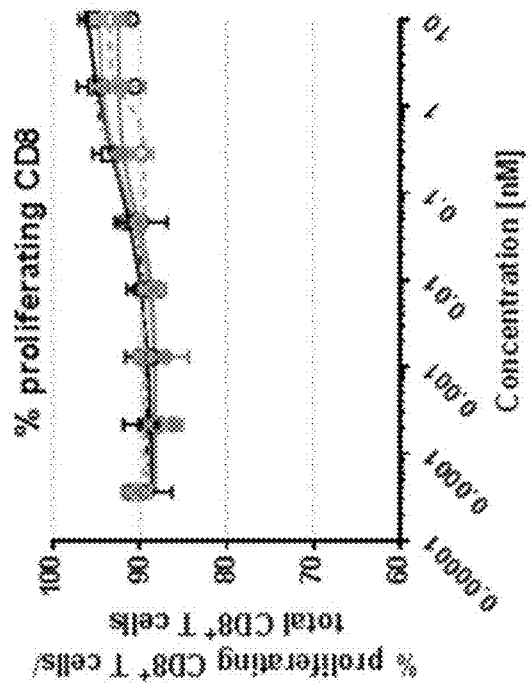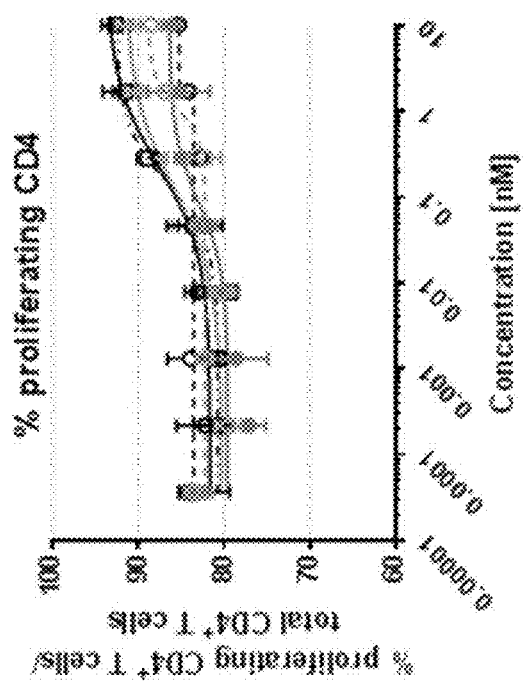
Fig. 24C
Fig. 24D

BISPECIFIC ANTIGEN BINDING MOLECULES COMPRISING ANTI-4-1BB CLONE 20H4.9

CROSS REFERENCE TO RELATED APPLICATIONS

This application is a continuation of International Application No. PCT/EP2018/050024, having an International filing date of Jan. 2, 2018, claiming priority to application number EP 17150150.5 filed Jan. 3, 2017 and application number EP 17164224.2 filed Mar. 31, 2017, each of which are incorporated herein by reference in its entirety.

SEQUENCE LISTING

This application contains a Sequence Listing which has been submitted electronically in ASCII format and is hereby incorporated by reference in its entirety. Said ASCII copy, created on Jun. 13, 2019, is named P34053-US_Sequence_Listing.txt and is 639,716 bytes in size.

FIELD OF THE INVENTION

The invention relates to new bispecific antigen binding molecules, comprising at least one antigen binding domain capable of specific binding to 4-1BB, at least one moiety capable of specific binding to a target cell antigen, and a Fc domain composed of a first and a second subunit capable of stable association. The invention further relates to methods of producing these molecules and to methods of using the same.

BACKGROUND 4-1BB (CD137), a member of the TNF receptor superfamily, has been first identified as a molecule whose expression is induced by T-cell activation (Kwon Y. H. and Weissman S. M. (1989), Proc. Natl. Acad. Sci. USA 86, 1963-1967). Subsequent studies demonstrated expression of 4-1BB in T- and B-lymphocytes (Snell L. M. et al. (2011) Immunol. Rev. 244, 197-217 or Zhang X. et al. (2010), J. Immunol. 184, 787-795), NK-cells (Lin W. et al. (2008), Blood 112, 699-707, NKT-cells (Kim D. H. et al. (2008), J. Immunol. 180, 2062-2068), monocytes (Kienzle G. and von Kempis J. (2000), Int. Immunol. 12, 73-82, or Schwarz H. et al. (1995), Blood 85, 1043-1052), neutrophils (Heinisch I. V. et al. (2000), Eur. J. Immunol. 30, 3441-3446), mast (Nishimoto H. et al. (2005), Blood 106, 4241-4248), and dendritic cells as well as cells of non-hematopoietic origin such as endothelial and smooth muscle cells (Broll K. et al. (2001), Am. J. Clin. Pathol. 115, 543-549 or Olofsson P. S. et al. (2008), Circulation 117, 1292-1301). Expression of 4-1BB in different cell types is mostly inducible and driven by various stimulatory signals, such as T-cell receptor (TCR) or B-cell receptor triggering, as well as signaling induced through co-stimulatory molecules or receptors of pro-inflammatory cytokines (Diehl L. et al. (2002), J. Immunol. 168, 3755-3762; von Kempis J. et al. (1997), Osteoarthritis Cartilage 5, 394-406; Zhang X. et al. (2010), J. Immunol. 184, 787-795).

CD137 signaling is known to stimulate IFNγ secretion and proliferation of NK cells (Buechele C. et al. (2012), Eur. J. Immunol. 42, 737-748; Lin W. et al. (2008), Blood 112, 699-707; Melero I. et al. (1998), Cell Immunol. 190, 167-172) as well as to promote DC activation as indicated by their increased survival and capacity to secret cytokines and upregulate co-stimulatory molecules (Choi B. K. et al. (2009), J. Immunol. 182, 4107-4115; Futagawa T. et al. (2002), Int. Immunol. 14, 275-286; Wilcox R. A. et al. (2002), J. Immunol. 168, 4262-4267). However, CD137 is best characterized as a co-stimulatory molecule which modulates TCR-induced activation in both the $CD4^+$ and $CD8^+$ subsets of T-cells. In combination with TCR triggering, agonistic 4-1BB-specific antibodies enhance proliferation of T-cells, stimulate lymphokine secretion and decrease sensitivity of T-lymphocytes to activation-induced cells death (Snell L. M. et al. (2011) Immunol. Rev. 244, 197-217). In line with these co-stimulatory effects of 4-1BB antibodies on T-cells in vitro, their administration to tumor bearing mice leads to potent anti-tumor effects in many experimental tumor models (Melero I. et al. (1997), Nat. Med. 3, 682-685; Narazaki H. et al. (2010), Blood 115, 1941-1948). In vivo depletion experiments demonstrated that $CD8^+$ T-cells play the most critical role in anti-tumoral effect of 4-1BB-specific antibodies. However, depending on the tumor model or combination therapy, which includes anti-4-1BB, contributions of other types of cells such as DCs, NK-cells or $CD4^+$ T-cells have been reported (Murillo O. et al. (2009), Eur. J. Immunol. 39, 2424-2436; Stagg J. et al. (2011), Proc. Natl. Acad. Sci. USA 108, 7142-7147).

It appears that the immunomodulatory properties of 4-1BB agonistic antibodies in vivo require the presence of the wild type Fc-portion on the antibody molecule thereby implicating Fc-receptor binding as an important event required for the pharmacological activity of such reagents as has been described for agonistic antibodies specific to other apoptosis-inducing or immunomodulatory members of the TNFR-superfamily (Li F. and Ravetch J. V. (2011), Science 333, 1030-1034; Teng M. W. et al. (2009), J. Immunol. 183, 1911-1920). However, systemic administration of 4-1BB-specific agonistic antibodies with the functionally active Fc domain also induces expansion of $CD8^+$ T-cells associated with liver toxicity (Dubrot J. et al. (2010), Cancer Immunol. Immunother. 59, 1223-1233) that is diminished or significantly ameliorated in the absence of functional Fc-receptors in mice.

Urelumab (BMS-666513, clone 1007) is a fully human, agonistic non-ligand blocking monoclonal IgG4 antibody that binds to the 4-1BB extracellular domain. It is disclosed as 20H4.9-IgG4 in U.S. Pat. No. 7,288,638. In human clinical trials (ClinicalTrials.gov, NCT00309023 and NCT00612664), urelumab administered once every three weeks for 12 weeks induced stabilization of the disease in patients with melanoma, ovarian or renal cell carcinoma. However, the trials were terminated as the antibody caused grade 4 hepatitis leading to the occurrence of two hepatotoxicity-related deaths (Simeone E. and Ascierto P. A. (2012), J. Immunotoxicology 9, 241-247). Subsequent detailed analysis of the clinical safety data demonstrated that the development of severe transaminitis is mainly triggered by the dose of urelumab given. Grade 2+ neutropenia, leukopenia and thropmbocytopenia were also observed. Subsequent detailed analysis of the clinical safety data demonstrated that the development of severe transaminitis is mainly triggered by the dose of urelumab given. In 2012, urelumab re-entered clinical development, however under the condition that doses <1 µg/kg given every three weeks were used. The current recommended dose is 0.1 µg/kg given every three weeks (N. Segal et al. (2016), Results From an Integrated Safety Analysis of Urelumab, an Agonist Anti-CD137 Monoclonal Antibody, Clin. Cancer Res., published online Dec. 1, 2016). In view of the dose-limiting toxicity there is thus a need for improved antigen binding molecule specific for 4-1BB that should act only at the tumor-specific sites in order to avoid uncontrollable side effects. The bispecific antigen binding molecules of the invention combine an antigen binding domain capable of preferred binding to tumor-specific or tumor-associated antigen with at least one antigen binding domain capable of agonistic binding to 4-1BB. The bispecific antigen binding molecules of this invention may be able to trigger 4-1BB not only effectively, but also very selectively at the desired site thereby reducing undesirable side effects that have been observed with conventional monospecific antibodies such as urelumab.

SUMMARY OF THE INVENTION

The present invention relates to bispecific antigen binding molecules combining at least one antigen binding domain capable of specific binding to 4-1BB, in particular wherein the antigen binding domain capable of specific binding to 4-1BB comprises a heavy chain variable region ($V_H$4-1BB) comprising (i) CDR-H1 comprising the amino acid sequence of SEQ ID NO:1, (ii) CDR-H2 comprising the amino acid sequence of SEQ ID NO:2, and (iii) CDR-H3 comprising the amino acid sequence of SEQ ID NO:3, and a light chain variable region ($V_L$4-1BB) comprising (iv) CDR-L1 comprising the amino acid sequence of SEQ ID NO:4, (v) CDR-L2 comprising the amino acid sequence of SEQ ID NO:5, and (vi) CDR-L3 comprising the amino acid sequence of SEQ ID NO:6, with at least one antigen binding domain capable of specific binding to a target cell antigen. These bispecific antigen binding molecules are advantageous as they will preferably activate 4-1BB at the site where the target cell antigen is expressed, due to their binding capability towards a target cell antigen and reduce activation at other sites in the body, thereby avoiding side effects of a antigen binding molecule specific for 4-1BB alone. In addition, the bispecific antigen binding molecules of the invention comprise a Fc domain composed of a first and a second subunit capable of stable association, in particular an IgG Fc domain, which enhances the pharmacological and pharmacokinetic properties of the bispecific antigen binding molecule.

In one aspect, the invention provides a bispecific antigen binding molecule, at least one antigen binding domain capable of specific binding to 4-1BB, at least one antigen binding domain capable of specific binding to a target cell antigen and a Fc domain composed of a first and a second subunit capable of stable association,
wherein the antigen binding domain capable of specific binding to 4-1BB comprises a heavy chain variable region ($V_H$4-1BB) comprising (i) CDR-H1 comprising the amino acid sequence of SEQ ID NO:1, (ii) CDR-H2 comprising the amino acid sequence of SEQ ID NO:2, and (iii) CDR-H3 comprising the amino acid sequence of SEQ ID NO:3, and a light chain variable region ($V_L$4-1BB) comprising (iv) CDR-L1 comprising the amino acid sequence of SEQ ID NO:4, (v) CDR-L2 comprising the amino acid sequence of SEQ ID NO:5, and (vi) CDR-L3 comprising the amino acid sequence of SEQ ID NO:6.

In a particular aspect, the bispecific antigen binding molecule comprises at least one antigen binding domain capable of specific binding to 4-1BB comprising a heavy chain variable region ($V_H$4-1BB) comprising an amino acid sequence that is at least about 95%, 96%, 97%, 98%, 99% or 100% identical to the amino acid sequence of SEQ ID NO:7 and a light chain variable region ($V_L$4-1BB) comprising an amino acid sequence that is at least about 95%, 96%, 97%, 98%, 99% or 100% identical to the amino acid sequence of SEQ ID NO:8. More particularly, the antigen binding domain capable of specific binding to 4-1BB comprises a heavy chain variable region ($V_H$4-1BB) comprising the amino acid sequence of SEQ ID NO:7 and a light chain variable region ($V_L$4-1BB) comprising the amino acid sequence of SEQ ID NO:8.

In one aspect, the antigen binding domain capable of specific binding to 4-1BB is a Fab fragment.

In a further aspect, provided is a bispecific antigen binding molecule, at least one antigen binding domain capable of specific binding to 4-1BB, at least one antigen binding domain capable of specific binding to a target cell antigen and a Fc domain composed of a first and a second subunit capable of stable association, wherein the antigen binding domain capable of specific binding to 4-1BB comprises a heavy chain variable region ($V_H$4-1BB) comprising (i) CDR-H1 comprising the amino acid sequence of SEQ ID NO:1, (ii) CDR-H2 comprising the amino acid sequence of SEQ ID NO:2, and (iii) CDR-H3 comprising the amino acid sequence of SEQ ID NO:3, and a light chain variable region ($V_L$4-1BB) comprising (iv) CDR-L1 comprising the amino acid sequence of SEQ ID NO:4, (v) CDR-L2 comprising the amino acid sequence of SEQ ID NO:5, and (vi) CDR-L3 comprising the amino acid sequence of SEQ ID NO:6, and wherein the target cell antigen is selected from the group consisting of Fibroblast Activation Protein (FAP), Melanoma-associated Chondroitin Sulfate Proteoglycan (MCSP), Epidermal Growth Factor Receptor (EGFR), Carcinoembryonic Antigen (CEA), CD19, CD20 and CD33.

In one aspect, the invention provides a bispecific antigen binding molecule, wherein the antigen binding domain capable of specific binding to a target cell antigen is an antigen binding domain capable of specific binding to Fibroblast Activation Protein (FAP).

Particularly, a bispecific antigen binding molecule is provided, wherein the antigen binding domain capable of specific binding to Fibroblast Activation Protein (FAP) comprises
(a) a heavy chain variable region ($V_H$FAP) comprising (i) CDR-H1 comprising the amino acid sequence of SEQ ID NO:9, (ii) CDR-H2 comprising the amino acid sequence of SEQ ID NO:10, and (iii) CDR-H3 comprising the amino acid sequence of SEQ ID NO:11, and a light chain variable region ($V_L$FAP) comprising (iv) CDR-L1 comprising the amino acid sequence of SEQ ID NO:12, (v) CDR-L2 comprising the amino acid sequence of SEQ ID NO:13, and (vi) CDR-L3 comprising the amino acid sequence of SEQ ID NO:14, or
(b) a heavy chain variable region ($V_H$FAP) comprising (i) CDR-H1 comprising the amino acid sequence of SEQ ID NO:15, (ii) CDR-H2 comprising the amino acid sequence of SEQ ID NO:16, and (iii) CDR-H3 comprising the amino acid sequence of SEQ ID NO:17, and a a light chain variable region ($V_L$FAP) comprising (iv) CDR-L1 comprising the amino acid sequence of SEQ ID NO:18, (v) CDR-L2 comprising the amino acid sequence of SEQ ID NO:19, and (vi) CDR-L3 comprising the amino acid sequence of SEQ ID NO:20.

In a further aspect, the antigen binding domain capable of specific binding to Fibroblast Activation Protein (FAP) comprises
(a) a heavy chain variable region ($V_H$FAP) comprising an amino acid sequence that is at least about 95%, 96%, 97%, 98%, 99% or 100% identical to the amino acid sequence of SEQ ID NO:21, and a light chain variable region ($V_L$FAP) comprising an amino acid sequence that is at least about 95%, 96%, 97%, 98%, 99% or 100% identical to the amino acid sequence of SEQ ID NO:22, or (b) a heavy chain variable region ($V_H$FAP) comprising an amino acid sequence that is at least about 95%, 96%, 97%, 98%, 99% or 100% identical to the amino acid sequence of SEQ ID NO:23, and a light chain variable region ($V_L$FAP) comprising an amino acid sequence that is at least about 95%, 96%, 97%, 98%, 99% or 100% identical to the amino acid sequence of SEQ ID NO:24.

Furthermore, provided is a bispecific antigen binding molecule, wherein
(i) the antigen binding domain capable of specific binding to 4-1BB comprises a heavy chain variable region VH comprising the amino acid sequence of SEQ ID NO: 7 and a light chain variable region comprising an amino acid sequence of SEQ ID NO: 8 and
(ii) the antigen binding domain capable of specific binding to FAP comprises a heavy chain variable region VH comprising an amino acid sequence of SEQ ID NO:23 and a light chain variable region comprising an amino acid sequence of SEQ ID NO:24.

In another aspect, provided is a bispecific antigen binding molecule, wherein
(i) the antigen binding domain capable of specific binding to 4-1BB comprises a heavy chain variable region VH comprising the amino acid sequence of SEQ ID NO: 7 and a light chain variable region comprising an amino acid sequence of SEQ ID NO: 8 and
(ii) the antigen binding domain capable of specific binding to FAP comprises a heavy chain variable region VH comprising an amino acid sequence of SEQ ID NO:21 and a light chain variable region comprising an amino acid sequence of SEQ ID NO:22.

In another aspect, the invention provides a bispecific antigen binding molecule, wherein the antigen binding domain capable of specific binding to a target cell antigen is an antigen binding domain capable of specific binding to Carcinoembryonic Antigen (CEA).

Particularly, a bispecific antigen binding molecule is provided, wherein the antigen binding domain capable of specific binding to Carcinoembryonic Antigen (CEA) comprises
(a) a heavy chain variable region ($V_H$CEA) comprising (i) CDR-H1 comprising the amino acid sequence of SEQ ID NO:25, (ii) CDR-H2 comprising the amino acid sequence of SEQ ID NO:26, and (iii) CDR-H3 comprising the amino acid sequence of SEQ ID NO:27, and a light chain variable region ($V_L$CEA) comprising (iv) CDR-L1 comprising the amino acid sequence of SEQ ID NO:28, (v) CDR-L2 comprising the amino acid sequence of SEQ ID NO:29, and (vi) CDR-L3 comprising the amino acid sequence of SEQ ID NO:30, or
(b) a heavy chain variable region ($V_H$CEA) comprising (i) CDR-H1 comprising the amino acid sequence of SEQ ID NO:33, (ii) CDR-H2 comprising the amino acid sequence of SEQ ID NO:34, and (iii) CDR-H3 comprising the amino acid sequence of SEQ ID NO:35, and a light chain variable region ($V_L$CEA) comprising (iv) CDR-L1 comprising the amino acid sequence of SEQ ID NO:36, (v) CDR-L2 comprising the amino acid sequence of SEQ ID NO:37, and (vi) CDR-L3 comprising the amino acid sequence of SEQ ID NO:38, or
(c) a heavy chain variable region ($V_H$CEA) comprising (i) CDR-H1 comprising the amino acid sequence of SEQ ID NO:179, (ii) CDR-H2 comprising the amino acid sequence of SEQ ID NO:180, and (iii) CDR-H3 comprising the amino acid sequence of SEQ ID NO:181, and a light chain variable region ($V_L$CEA) comprising (iv) CDR-L1 comprising the amino acid sequence of SEQ ID NO:182, (v) CDR-L2 comprising the amino acid sequence of SEQ ID NO:183, and (vi) CDR-L3 comprising the amino acid sequence of SEQ ID NO:184, or
(d) a heavy chain variable region ($V_H$CEA) comprising (i) CDR-H1 comprising the amino acid sequence of SEQ ID NO:187, (ii) CDR-H2 comprising the amino acid sequence of SEQ ID NO:188, and (iii) CDR-H3 comprising the amino acid sequence of SEQ ID NO:189, and a light chain variable region ($V_L$CEA) comprising (iv) CDR-L1 comprising the amino acid sequence of SEQ ID NO:190, (v) CDR-L2 comprising the amino acid sequence of SEQ ID NO:191, and (vi) CDR-L3 comprising the amino acid sequence of SEQ ID NO:192.

In another aspect, the antigen binding domain capable of specific binding to Carcinoembryonic Antigen (CEA) comprises (a) a heavy chain variable region ($V_H$CEA) comprising an amino acid sequence that is at least about 95%, 96%, 97%, 98%, 99% or 100% identical to the amino acid sequence of SEQ ID NO:31, and a light chain variable region ($V_L$CEA) comprising an amino acid sequence that is at least about 95%, 96%, 97%, 98%, 99% or 100% identical to the amino acid sequence of SEQ ID NO:32, or (b) a heavy chain variable region ($V_H$CEA) comprising an amino acid sequence that is at least about 95%, 96%, 97%, 98%, 99% or 100% identical to the amino acid sequence of SEQ ID NO:39, and a light chain variable region ($V_L$CEA) comprising an amino acid sequence that is at least about 95%, 96%, 97%, 98%, 99% or 100% identical to the amino acid sequence of SEQ ID NO:40, or (c) a heavy chain variable region ($V_H$CEA) comprising an amino acid sequence that is at least about 95%, 96%, 97%, 98%, 99% or 100% identical to the amino acid sequence of SEQ ID NO:185, and a light chain variable region ($V_L$CEA) comprising an amino acid sequence that is at least about 95%, 96%, 97%, 98%, 99% or 100% identical to the amino acid sequence of SEQ ID NO:186, or (d) a heavy chain variable region ($V_H$CEA) comprising an amino acid sequence that is at least about 95%, 96%, 97%, 98%, 99% or 100% identical to the amino acid sequence of SEQ ID NO:193, and a light chain variable region ($V_L$CEA) comprising an amino acid sequence that is at least about 95%, 96%, 97%, 98%, 99% or 100% identical to the amino acid sequence of SEQ ID NO:194.

In a particular aspect, provided is a bispecific antigen binding molecule, wherein
(i) the antigen binding domain capable of specific binding to 4-1BB comprises a heavy chain variable region VH comprising the amino acid sequence of SEQ ID NO: 7 and a light chain variable region comprising an amino acid sequence of SEQ ID NO: 8 and
(ii) the antigen binding domain capable of specific binding to CEA comprises a heavy chain variable region VH comprising an amino acid sequence of SEQ ID NO:31 and a light chain variable region comprising an amino acid sequence of SEQ ID NO:32.

In a further aspect, provided is a bispecific antigen binding molecule, wherein
(i) the antigen binding domain capable of specific binding to 4-1BB comprises a heavy chain variable region VH comprising the amino acid sequence of SEQ ID NO: 7 and a light chain variable region comprising an amino acid sequence of SEQ ID NO: 8 and
(ii) the antigen binding domain capable of specific binding to CEA comprises a heavy chain variable region VH comprising an amino acid sequence of SEQ ID NO:39 and a light chain variable region comprising an amino acid sequence of SEQ ID NO:40.

In a further aspect, provided is a bispecific antigen binding molecule, wherein
(i) the antigen binding domain capable of specific binding to 4-1BB comprises a heavy chain variable region VH comprising the amino acid sequence of SEQ ID NO: 7 and a light chain variable region comprising an amino acid sequence of SEQ ID NO: 8 and
(ii) the antigen binding domain capable of specific binding to CEA comprises a heavy chain variable region VH comprising an amino acid sequence of SEQ ID NO:185 and a light chain variable region comprising an amino acid sequence of SEQ ID NO:186.

In yet a further aspect, provided is a bispecific antigen binding molecule, wherein
(i) the antigen binding domain capable of specific binding to 4-1BB comprises a heavy chain variable region VH comprising the amino acid sequence of SEQ ID NO: 7 and a light chain variable region comprising an amino acid sequence of SEQ ID NO: 8 and
(ii) the antigen binding domain capable of specific binding to CEA comprises a heavy chain variable region VH comprising an amino acid sequence of SEQ ID NO:193 and a light chain variable region comprising an amino acid sequence of SEQ ID NO:194.

In another aspect, the invention provides a bispecific antigen binding molecule, wherein the antigen binding domain capable of specific binding to a target cell antigen is an antigen binding domain capable of specific binding to CD19.

Particularly, a bispecific antigen binding molecule is provided, wherein the antigen binding domain capable of specific binding to CD19 comprises
(a) a heavy chain variable region ($V_H$CD19) comprising (i) CDR-H1 comprising the amino acid sequence of SEQ ID NO:155, (ii) CDR-H2 comprising the amino acid sequence of SEQ ID NO:156, and (iii) CDR-H3 comprising the amino acid sequence of SEQ ID NO:157, and a light chain variable region ($V_L$CD19) comprising (iv) CDR-L1 comprising the amino acid sequence of SEQ ID NO:158, (v) CDR-L2 comprising the amino acid sequence of SEQ ID NO:159, and (vi) CDR-L3 comprising the amino acid sequence of SEQ ID NO:160, or
(b) a heavy chain variable region ($V_H$CD19) comprising (i) CDR-H1 comprising the amino acid sequence of SEQ ID NO:163, (ii) CDR-H2 comprising the amino acid sequence of SEQ ID NO:164, and (iii) CDR-H3 comprising the amino acid sequence of SEQ ID NO:165, and a light chain variable region ($V_L$CD19) comprising (iv) CDR-L1 comprising the amino acid sequence of SEQ ID NO:166, (v) CDR-L2 comprising the amino acid sequence of SEQ ID NO:167, and (vi) CDR-L3 comprising the amino acid sequence of SEQ ID NO:168.

In another aspect, the antigen binding domain capable of specific binding to CD19 comprises (a) a heavy chain variable region ($V_H$CD19) comprising an amino acid sequence that is at least about 95%, 96%, 97%, 98%, 99% or 100% identical to the amino acid sequence of SEQ ID NO:161, and a light chain variable region ($V_L$CD19) comprising an amino acid sequence that is at least about 95%, 96%, 97%, 98%, 99% or 100% identical to the amino acid sequence of SEQ ID NO:162, or (b) a heavy chain variable region ($V_H$CD19) comprising an amino acid sequence that is at least about 95%, 96%, 97%, 98%, 99% or 100% identical to the amino acid sequence of SEQ ID NO:169, and a light chain variable region ($V_L$CD19) comprising an amino acid sequence that is at least about 95%, 96%, 97%, 98%, 99% or 100% identical to the amino acid sequence of SEQ ID NO:170.

In a particular aspect, provided is a bispecific antigen binding molecule, wherein
(i) the antigen binding domain capable of specific binding to 4-1BB comprises a heavy chain variable region VH comprising the amino acid sequence of SEQ ID NO: 7 and a light chain variable region comprising an amino acid sequence of SEQ ID NO: 8 and
(ii) the antigen binding domain capable of specific binding to CD19 comprises a heavy chain variable region VH comprising an amino acid sequence of SEQ ID NO:161 and a light chain variable region comprising an amino acid sequence of SEQ ID NO:162.

In a further aspect, provided is a bispecific antigen binding molecule, wherein
(i) the antigen binding domain capable of specific binding to 4-1BB comprises a heavy chain variable region VH comprising the amino acid sequence of SEQ ID NO: 7 and a light chain variable region comprising an amino acid sequence of SEQ ID NO: 8 and
(ii) the antigen binding domain capable of specific binding to CD19 comprises a heavy chain variable region VH comprising an amino acid sequence of SEQ ID NO:169 and a light chain variable region comprising an amino acid sequence of SEQ ID NO:170.

In one aspect, the bispecific antigen binding molecule is a human, a humanized or a chimeric antibody. In particular, the bispecific antigen binding molecule comprises an IgG Fc domain, particularly an IgG1 Fc domain or an IgG4 Fc domain.

In a further aspect, provided is a bispecific antigen binding molecule, wherein the Fc domain comprises one or more amino acid substitution that reduces the binding affinity of the antibody to an Fc receptor and/or effector function. In particular, the Fc domain is of human IgG1 subclass with the amino acid mutations L234A, L235A and P329G (numbering according to Kabat EU index).

In a further aspect, provided is a bispecific antigen binding molecule, wherein the Fc domain comprises a modification promoting the association of the first and second subunit of the Fc domain. In a particular aspect, the invention provides a bispecific antigen binding molecule, wherein the first subunit of the Fc domain comprises knobs and the second subunit of the Fc domain comprises holes according to the knobs into holes method. More particularly, the first subunit of the Fc domain comprises the amino acid substitutions S354C and T366W (numbering according to Kabat EU index) and the second subunit of the Fc domain comprises the amino acid substitutions Y349C, T366S, L368A and Y407V (numbering according to Kabat EU index).

In another aspect, the invention provides a bispecific antigen binding molecule comprising more than one antigen binding domain capable of specific binding to 4-1BB, wherein each antigen binding domain capable of specific binding to 4-1BB comprises
a heavy chain variable region ($V_H$4-1BB) comprising (i) CDR-H1 comprising the amino acid sequence of SEQ ID NO:1, (ii) CDR-H2 comprising the amino acid sequence of SEQ ID NO:2, and (iii) CDR-H3 comprising the amino acid sequence of SEQ ID NO:3, and a light chain variable region ($V_L$4-1BB) comprising (iv) CDR-L1 comprising the amino acid sequence of SEQ ID NO:4, (v) CDR-L2 comprising the amino acid sequence of SEQ ID NO:5, and (vi) CDR-L3 comprising the amino acid sequence of SEQ ID NO:6.

In one aspect, provided is a bispecific antigen binding molecule, comprising
(a) two antigen binding domains capable of specific binding to 4-1BB,
(b) one antigen binding domain capable of specific binding to a target cell antigen, and
(c) a Fc domain composed of a first and a second subunit capable of stable association.

In a particular aspect, provided is a bispecific antigen binding molecule, comprising
(a) two antigen binding domains capable of specific binding to 4-1BB,
(b) one antigen binding domain capable of specific binding to a target cell antigen, and
(c) an IgG Fc domain comprising one or more amino acid substitution that reduces the binding affinity of the antigen binding molecule to an Fc receptor and/or effector function. More particularly, the IgG Fc domain comprises one or more amino acid substitution that reduces the binding affinity of the antigen binding molecule to an Fc receptor and/or effector function.

Thus, provided is a bispecific antigen binding molecule, wherein the bispecific antigen binding molecule is bivalent both for 4-1BB and monovalent for the target cell antigen.

In one aspect, the bispecific antigen binding molecule comprises
(a) two light chains and two heavy chains of an antibody comprising two Fab fragments capable of specific binding to 4-1BB and the Fc domain, and
(b) a VH and VL domain capable of specific binding to a target cell antigen, wherein the VH domain is connected via a peptide linker to the C-terminus of one of the two heavy chains and wherein the VL domain is connected via a peptide linker to the C-terminus of the second heavy chain.

In a further aspect, provided is a bispecific antigen binding molecule, comprising
(a) two light chains, each comprising the amino acid sequence of SEQ ID NO:46, a first heavy chain comprising the amino acid sequence of SEQ ID NO:44, and a second heavy chain comprising the amino acid sequence of SEQ ID NO:45, or
(b) two light chains, each comprising the amino acid sequence of SEQ ID NO:46, a first heavy chain comprising the amino acid sequence of SEQ ID NO:49, and a second heavy chain comprising the amino acid sequence of SEQ ID NO:50.

In another aspect, provided is a bispecific antigen binding molecule, comprising
(a) two light chains, each comprising the amino acid sequence of SEQ ID NO:46, a first heavy chain comprising the amino acid sequence of SEQ ID NO:65, and a second heavy chain comprising the amino acid sequence of SEQ ID NO:66, or
(b) two light chains, each comprising the amino acid sequence of SEQ ID NO:46, a first heavy chain comprising the amino acid sequence of SEQ ID NO:69, and a second heavy chain comprising the amino acid sequence of SEQ ID NO:70, or
(c) two light chains, each comprising the amino acid sequence of SEQ ID NO:46, a first heavy chain comprising the amino acid sequence of SEQ ID NO:73, and a second heavy chain comprising the amino acid sequence of SEQ ID NO:74, or
(d) two light chains, each comprising the amino acid sequence of SEQ ID NO:46, a first heavy chain comprising the amino acid sequence of SEQ ID NO:77, and a second heavy chain comprising the amino acid sequence of SEQ ID NO:78.

In a further aspect, the invention provides a bispecific antigen binding molecule comprising
(a) two light chains and two heavy chains of an antibody comprising two Fab fragments capable of specific binding to 4-1BB and the Fc domain, and
(b) a crossFab fragment capable of specific binding to the target cell antigen which is connected via a peptide linker to the C-terminus of one of the two heavy chains.

In a particular aspect, the crossfab fragment is capable of specific binding to FAP, CEA or CD19. More particularly, the crossfab fragment is capable of specific binding to CEA.

In another aspect, provided is a bispecific antigen binding molecule, comprising
(a) two light chains, each comprising the amino acid sequence of SEQ ID NO:46, a first heavy chain comprising the amino acid sequence of SEQ ID NO:211, a second heavy chain comprising the amino acid sequence of SEQ ID NO:212, and a further light chain comprising the amino acid sequence of SEQ ID NO:213, or
(b) two light chains, each comprising the amino acid sequence of SEQ ID NO:216, a first heavy chain comprising the amino acid sequence of SEQ ID NO:214, a second heavy chain comprising the amino acid sequence of SEQ ID NO:215, and a further light chain comprising the amino acid sequence of SEQ ID NO:217.

In another aspect, the invention provides a bispecific antigen binding molecule comprising
(a) four antigen binding domains capable of specific binding to 4-1BB,
(b) one antigen binding domain capable of specific binding to a target cell antigen, and
(c) a Fc domain composed of a first and a second subunit capable of stable association.

Thus, provided is a bispecific antigen binding molecule, wherein the bispecific antigen binding molecule is tetravalent for 4-1BB and monovalent for the target cell antigen.

In a particular aspect, provided is a bispecific antigen binding molecule, wherein the four antigen binding domains capable of specific binding to 4-1BB are Fab fragments and each two thereof are fused to each other, optionally via a peptide linker.

In one aspect, the invention provides a bispecific antigen binding molecule wherein the antigen binding domain capable of specific binding to a target cell antigen comprises a VH and VL domain and wherein the VH domain is connected via a peptide linker to the C-terminus of the first subunit of the Fc domain and the VL domain is connected via a peptide linker to the C-terminus of the second subunit of the Fc domain.

In a further aspect, provided is a bispecific antigen binding molecule, comprising
(a) four light chains, each comprising the amino acid sequence of SEQ ID NO:46, a first heavy chain comprising the amino acid sequence of SEQ ID NO:57, and a second heavy chain comprising the amino acid sequence of SEQ ID NO:58, or
(b) four light chains, each comprising the amino acid sequence of SEQ ID NO:46, a first heavy chain comprising the amino acid sequence of SEQ ID NO:61, and a second heavy chain comprising the amino acid sequence of SEQ ID NO:62.

In another aspect, provided is a bispecific antigen binding molecule, comprising (a) four light chains, each comprising the amino acid sequence of SEQ ID NO:46, a first heavy chain comprising the amino acid sequence of SEQ ID NO:81, and a second heavy chain comprising the amino acid sequence of SEQ ID NO:82, or (b) four light chains, each comprising the amino acid sequence of SEQ ID NO:46, a first heavy chain comprising the amino acid sequence of SEQ ID NO:85, and a second heavy chain comprising the amino acid sequence of SEQ ID NO:86, or (c) four light chains, each comprising the amino acid sequence of SEQ ID NO:46, a first heavy chain comprising the amino acid sequence of SEQ ID NO:89, and a second heavy chain comprising the amino acid sequence of SEQ ID NO:90, or (d) four light chains, each comprising the amino acid sequence of SEQ ID NO:46, a first heavy chain comprising the amino acid sequence of SEQ ID NO:93, and a second heavy chain comprising the amino acid sequence of SEQ ID NO:94.

According to another aspect of the invention, there is provided an isolated polynucleotide encoding a bispecific antigen binding molecule as described herein before. The invention further provides a vector, particularly an expression vector, comprising the isolated polynucleotide of the invention and a host cell comprising the isolated polynucleotide or the vector of the invention. In some aspects the host cell is a eukaryotic cell, particularly a mammalian cell.

In another aspect, provided is a method for producing a bispecific antigen binding molecule as described herein before, comprising the steps of (i) culturing the host cell of the invention under conditions suitable for expression of the antigen binding molecule, and (ii) recovering the antigen binding molecule. The invention also encompasses the bispecific antigen binding molecule produced by the method of the invention.

The invention further provides a pharmaceutical composition comprising a bispecific antigen binding molecule as described herein before and at least one pharmaceutically acceptable excipient. In one aspect, the pharmaceutical composition is for use in the treatment of cancer or infectious diseases. In particular, the pharmaceutical composition is for use in the treatment of cancer.

Also encompassed by the invention is the bispecific antigen binding molecule as described herein before, or the pharmaceutical composition comprising the bispecific antigen binding molecule, for use as a medicament.

In one aspect, provided is a bispecific antigen binding molecule as described herein before or the pharmaceutical composition of the invention, for use
(i) in stimulating T cell response,
(ii) in supporting survival of activated T cells,
(iii) in the treatment of infections,
(iv) in the treatment of cancer,
(v) in delaying progression of cancer, or
(vi) in prolonging the survival of a patient suffering from cancer.

In another aspect, the invention relates to a bispecific antigen binding molecule, comprising at least one antigen binding domain capable of specific binding to mouse 4-1BB, at least one antigen binding domain capable of specific binding to a target cell antigen and a Fc domain composed of a first and a second subunit capable of stable association, wherein the antigen binding domain capable of specific binding to mouse 4-1BB comprises a heavy chain variable region ($V_H$4-1BB) comprising (i) CDR-H1 comprising the amino acid sequence of SEQ ID NO:171, (ii) CDR-H2 comprising the amino acid sequence of SEQ ID NO:172, and (iii) CDR-H3 comprising the amino acid sequence of SEQ ID NO:173, and a light chain variable region ($V_L$4-1BB) comprising (iv) CDR-L1 comprising the amino acid sequence of SEQ ID NO:174, (v) CDR-L2 comprising the amino acid sequence of SEQ ID NO:175, and (vi) CDR-L3 comprising the amino acid sequence of SEQ ID NO:176.

In one aspect, provided is a bispecific antigen binding molecule, wherein the antigen binding domain capable of specific binding to mouse 4-1BB comprises a heavy chain variable region ($V_H$4-1BB) comprising an amino acid sequence that is at least about 95%, 96%, 97%, 98%, 99% or 100% identical to the amino acid sequence of SEQ ID NO:177 and a light chain variable region ($V_L$4-1BB) comprising an amino acid sequence that is at least about 95%, 96%, 97%, 98%, 99% or 100% identical to the amino acid sequence of SEQ ID NO:178. In particular, the antigen binding domain capable of specific binding to mouse 4-1BB comprises a heavy chain variable region ($V_H$4-1BB) comprising the amino acid sequence of SEQ ID NO:177 and a light chain variable region ($V_L$4-1BB) comprising the amino acid sequence of SEQ ID NO:178. In another specific aspect, the bispecific antigen binding molecule is one, wherein the antigen binding domain capable of specific binding to a target cell antigen binds to Fibroblast Activation Protein (FAP) and comprises (a) a heavy chain variable region ($V_H$FAP) comprising (i) CDR-H1 comprising the amino acid sequence of SEQ ID NO:9, (ii) CDR-H2 comprising the amino acid sequence of SEQ ID NO:10, and (iii) CDR-H3 comprising the amino acid sequence of SEQ ID NO:11, and a light chain variable region ($V_L$FAP) comprising (iv) CDR-L1 comprising the amino acid sequence of SEQ ID NO:12, (v) CDR-L2 comprising the amino acid sequence of SEQ ID NO:13, and (vi) CDR-L3 comprising the amino acid sequence of SEQ ID NO:14. In particular, provided is a bispecific antigen binding molecule as described herein before, wherein wherein the first subunit of the Fc domain comprises the amino acid substitutions K392D and K409D (numbering according to Kabat EU index) and the second subunit of the Fc region comprises the amino acid substitutions E356K and D399K (numbering according to Kabat EU index).

In a specific aspect, provided is the bispecific antigen binding molecule as described herein before, or the pharmaceutical composition of the invention, for use in the treatment of cancer. In another specific aspect, the invention provides the bispecific antigen binding molecule as described herein before for use in the treatment of cancer, wherein the bispecific antigen binding molecule is administered in combination with a chemotherapeutic agent, radiation therapy and/or other agents for use in cancer immunotherapy.

In a further aspect, the invention provides a method of inhibiting the growth of tumor cells in an individual comprising administering to the individual an effective amount of the bispecific antigen binding molecule as described herein before, or the pharmaceutical composition of the invention, to inhibit the growth of the tumor cells.

Also provided is the use of the bispecific antigen binding molecule as described herein before for the manufacture of a medicament for the treatment of a disease in an individual in need thereof, in particular for the manufacture of a medicament for the treatment of cancer or infectious diseases, as well as a method of treating a disease in an individual, comprising administering to said individual a therapeutically effective amount of a composition comprising the bispecific antigen binding molecule of the invention in a pharmaceutically acceptable form. In a specific aspect, the disease is cancer. In any of the above aspects the individual is a mammal, particularly a human.

BRIEF DESCRIPTION OF THE DRAWINGS

FIG. 1A shows the bispecific antigen binding molecule wherein the VL domain of the antigen binding domain capable of specific binding to a target cell antigen is fused to the C-terminus of the Fc hole chain, termed hole-VL, in FIG. 1B is shown the bispecific antigen binding molecule wherein the VH domain of the antigen binding domain capable of specific binding to a target cell antigen is fused to the C-terminus of the Fc hole chain, termed hole-VH. FIG. 1D shows the variant with CHCL crossfab, in FIG. 1E the variant with VHVL crossfab is shown. The triangles in FIG. 1E symbolize the possibility of charged variants (mutations in the CL domain of the amino acid at position 123 (EU numbering) to arginine (R) and of the amino acid at position 124 (EU numbering) to lysine (K) and in CH1 domain of the amino acids at position 147 (EU numbering) and at position 213 (EU numbering) to glutamic acid (E)).

FIG. 2A is a pictogram of the setup of the assay. FIG. 2B shows the simultaneous binding of the bispecific anti-4-1BB/anti-FAP antigen binding molecules (analyte 1) to immobilized human 4-1BB and human FAP (analyte 2).

FIG. 4A shows the bispecific antigen binding molecule wherein the VL domain of the antigen binding domain capable of specific binding to a target cell antigen is fused to the C-terminus of the Fc hole chain, termed hole-VL, in FIG. 1B is shown the bispecific antigen binding molecule wherein the VH domain of the antigen binding domain capable of specific binding to a target cell antigen is fused to the C-terminus of the Fc hole chain, termed hole-VH.

FIG. 5A is a pictogram of the setup of the assay. FIG. 5B shows the simultaneous binding of the bispecific anti-4-1BB/anti-FAP antigen binding molecules (analyte 1) to immobilized human 4-1BB and human FAP (analyte 2).

FIGS. 7A to 7D show the binding to resting and activated human T cells. The concentration of anti-4-1BB antigen binding molecules is blotted against the geo mean of fluorescence intensity (MFI) of the PE-conjugated secondary detection antibody. All values are baseline corrected by subtracting the baseline value of the blank control (e.g. no primary, only secondary detection antibody). In the upper panels the binding to resting CD4 T cells (FIG. 7A) or activated CD4 T cells (FIG. 7B) are shown. In the lower panels the binding to resting CD8 T cells (FIG. 7C) and activated CD8 T cells (FIG. 7D) are shown. Only 4-1BB-binding-domain-containing antigen binding molecules like 4-1BB (20H4.9) huIgG1 P329G LALA (black filled diamond), bispecific anti-4-1BB (20H4.9)/anti-FAP (4B9) 2+1 antigen binding molecule (black filled triangle, dotted line) and anti-4-1BB (20H4.9)/anti-FAP (4B9) 4+1 antigne binding molecule (grey filled square) bind efficiently to 4-1BB-expressing cells. No binding could be detected with the control molecule DP47 (germline control) huIgG1 P329G LALA (open black circles, dotted line).

In FIGS. 8A and 8B the binding to activated human T cells is shown. In this graphs the area under the curves of FIGS. 7C and 7D are displayed. In FIG. 8A the binding to activated CD8$^+$ T cells is shown and FIG. 8B illustrates the binding to activated CD4$^+$ T cells. Antibody 4-1BB (20H4.9) huIgG1 P329G LALA (black), bispecific antigen binding molecule 4-1BB (20H4.9)×FAP (4B9) 2+1 (chess), bispecific antigen binding molecule 4-1BB (20H4.9)×FAP (4B9) 4+1 (diagonal stripes) and control molecule DP47 huIgG1 P329G LALA are shown, respectively.

In FIGS. 9A and 9B the binding to human FAP-expressing cells is shown. The concentration of 4-1BB-binding molecules is blotted against the geo mean of fluorescence intensity (MFI) of the PE-conjugated secondary detection antibody. All values are baseline corrected by subtracting the baseline values of the blank control (e.g. no primary only secondary detection antibody). In FIG. 9A binding to intermediate-FAP-expressing human melanoma cell line WM-266-4 and in FIG. 9B binding to high-FAP-expressing NIH/3T3-huFAP clone 19 cells are shown. Only antigen binding molecules comprising a FAP antigen binding domain like 4-1BB (20H4.9)×FAP (4B9) 2+1 (black filled triangle and dotted line) and 4-1BB (20H4.9)×FAP (4B9) 4+1 (filled grey square) bind efficiently to FAP-expressing cells. No binding could be detected with non FAP-targeted molecules anti-4-1BB (20H4.9) huIgG1 P329G LALA (black filled triangle) and the control molecule DP47 huIgG1 P329G LALA (open black circles, dotted line).

FIGS. 10A to 10C show the NFκB-mediated luciferase expression in 4-1BB expressing reporter cell line HeLa-hu4-1BB-NFκB-luc. The concentration of 4-1BB-binding molecules is blotted against the units of released light (URL) measured after 6 h of incubation. All values are baseline corrected by subtracting the baseline values of the blank control (e.g. no antibodies added). In FIG. 10A FAP-target-independent 4-1BB activation is shown, whereby 4-1BB-binding induces NFκB-controlled luciferase expression in the reporter cell line without any FAP-mediated crosslinking. In FIG. 10B FAP-intermediate expressing human melanoma cell line WM-266-4 and in FIG. 10C high-FAP-expressing NIH/3T3-huFAP clone 19 were added in a ratio 5:1 to the reporter cell line. The FAP-expressing cells lead to a crosslinking of FAP-targeted 4-1BB-binding molecules and increase their potential to induce NFκB-mediated luciferase activation in the 4-1BB-expressing reporter cell line.

In FIG. 10D FAP-target-independent 4-1BB activation is shown, whereby 4-1BB-binding induces NFκB-controlled luciferase expression in the reporter cell line without any FAP-mediated crosslinking. In FIG. 10E FAP surface-expressing human melanoma cell line WM-266-4 was added in a ratio 5:1 to the reporter cell line. The FAP-expressing WM-266-4 cells lead to a crosslinking of the bispecific binding 4-1BB (20H4.9)×FAP (4B9) 1+1 molecule and increased its potential to induce NFκB-mediated luciferase activation in the 4-1BB-expressing reporter cell line.

FIGS. 11A to 11C also show NFκB-mediated luciferase expression in 4-1BB expressing reporter cell line HeLa-hu4-1BB-NFκB-luc. In this graphs the area under the curves of FIGS. 10A to 10C are displayed. 4-1BB (20H4.9) huIgG1 P329G LALA (black), 4-1BB (20H4.9)×FAP (4B9) 2+1 (chess), 4-1BB (20H4.9)×FAP (4B9) 4+1 (diagonal stripes) and control molecule DP47 huIgG1 P329G LALA (white) are shown, respectively.

In FIG. 13 all four parameters shown in FIGS. 12A to 12D are summarized as area under the curves. As negative control the untargeted DP47 huIgG1 P329G LALA molecule is shown to indicate the baseline activation and proliferation.

Figure 1B:
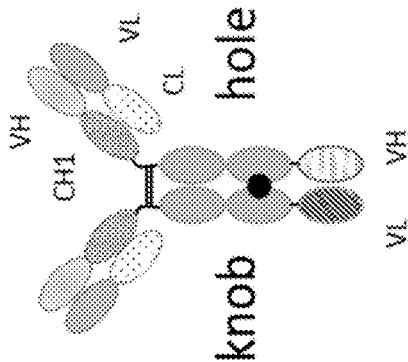
FIGS. 1A and 1B show examples of bispecific antigen binding molecules in huIgG1 P329GLALA format comprising two anti-4-1BB Fab fragments (bivalent binding to-4-1BB) and a VH and VL domain capable of specific binding to a target cell antigen, for example anti-FAP, anti-CEA or anti-CD19, fused at the C-terminus of the heavy chains, respectively. This format is termed herein also 2+1 format. The black dot symbolizes the knobs-into-holes mutations.

The induction of mouse T cell activation by bispecific mouse 4-1BB/FAP antigen binding molecules is shown in FIGS. 14A to 14J. The added concentration of agonistic mouse-4-1BB antibodies (x-axis) is blotted against the percentage of positive cells (FIG. 14A to 14H) or the mean of fluorescence intensity (FIGS. 14I and 14J) on the y-axis. On the left activation parameters of the CD8$^+$ T cells (FIGS. 14A, 14C, 14E, 14G and 14I) and on the right of the CD4$^+$ T cells (FIGS. 14B, 14D, 14F, 14H and 14J) are shown. Shown is increased 4-1BB expression on CD8$^+$ T cells (FIG. 14A) and CD4$^+$ T cells (FIG. 14B), increased CD25-expression on CD8$^+$ T cells (FIG. 14C) and CD4$^+$ T cells (FIG. 14D), increased Granzyme B expression in CD8$^+$ T cells (FIG. 14E) and CD4$^+$ T cells (FIG. 14F), increased proliferation of CD8$^+$ T cells (FIG. 14G) and CD4$^+$ T cells (FIG. 14H) and an increase of the cytosolic structure by increase sidewards scatter values in CD8$^+$ T cells (FIG. 14I) and CD4$^+$ T cells (FIG. 14J). The activation of mouse T cells with 0.5 µg/mL agonistic anti-mouse CD3 armenian hamster IgG (signal 1) in combination with crosslinked co-stimulatory agonistic anti-mouse 4-1BB antibody (signal 2) leads to increased T cell activation—shown by increased expression of 4-1BB, CD25 and Granzyme B as well as increased proliferation and cytosolic structure by mean fluorescence intensity of sideward scatter. The synergistic effects depend on the ability to bind 4-1BB and to be crosslinked at the same time. Crosslinking of agonistic anti-mouse 4-1BB antibody can be delivered by FcγR-binding (mouse 4-1BB (MU137-1) moIgG1 wt, black diamonds) or by simultaneously binding to FAP (mouse 4-1BB (MU137-1)×FAP (28H1) moIgG1 DAPG 2+1, grey star and dotted line). As shown for example by the proliferation of CD4$^+$ T cells (FIG. 14H) crosslinking via FAP is much more potent. Antibodies inert of binding to 4-1BB (untargeted moIgG1, open grey circle and dotted line) or inert of FcγR-binding (mouse 4-1BB (MU137-1) moIgG1 DAPG) are not able to increase CD8 and CD4 T cell activation above the background.

FIGS. 15A and 15B show the NFκB-mediated luciferase expression activity in 4-1BB expressing reporter cell line. The concentration of CEA-targeted agonistic 4-1BB-binding construct 4-1BB (20H4.9)×CEA (A5B7) 2+1 is blotted against the units of released light (URLs) measured after 6 h of incubation. All values are baseline corrected by subtracting the baseline values of the blank control (e.g. no antibodies added). In FIG. 15A CEA-target-independent 4-1BB activation is shown, whereby 4-1BB-binding induces NFκB-controlled luciferase expression in the reporter cell line without any CEA-mediated crosslinking. In FIG. 15B CEA surface-expressing human gastric adenocarcinoma cell line MKN45 was added in a ratio 5:1 to the reporter cell line. The CEA-expressing MKN45 cells lead to a crosslinking of the bispecific binding 4-1BB (20H4.9)×CEA (A4B7) 2+1 molecule and increase its potential to induce NFκB-induced/luciferase activation in the 4-1BB-expressing reporter cell line. AUC and EC$_{50}$ values are indicated in the blots as mean (SD).

FIG. 16A shows the structural 2+1 format of the bispecific, bivalent anti-4-1BB/monovalent anti-CD19 antibodies (called 4-1BBxCD19) as described in Example 8. The molecules are bispecific antigen binding molecules in huIgG1 P329GLALA format comprising two anti-4-1BB Fab fragments (bivalent binding to-4-1BB) and a VH and VL domain capable of specific binding to CD19, fused at the C-terminus of the heavy chains, respectively. The black dot symbolizes the knobs-into-holes mutations. Examples are 4-1BB(20H4.9)×CD19(2B11) or 4-1BB(20H4.9)×CD19 (8B8-018). FIG. 16B shows the positive control, a monovalent CD19 4-1BBL-trimer containing antigen binding molecule (huIgG1 P329G LALA) with modifications in the CH1 and CL domain adjacent to the 4-1BBL(71-248) dimer and 4-1BBL(71-248) monomer. The thick black point stands for the knob-into-hole modification. * symbolizes amino acid modifications in the CH1 and CL domain (so-called charged residues). The molecule is described in WO 2016/075278 A1 and is named CD19(2B11)×4-1BBL as it comprises CD19 binder clone 2B11. FIG. 16C shows the negative control, a untargeted (DP47) antigen binding molecule (huIgG1 P329G LALA) with the 4-1BBL(71-248) dimer fused to the C-terminus of the Fc knob chain and the the 4-1BBL (71-248) monomer fused to the C-terminus of the Fc hole chain.

In FIG. 17A the binding of 4-1BB×CD19 constructs to CD19+ human B cells is shown, as detected by a secondary antibody against human Fc. 4-1BB(20H4.9)×CD19(2B11) binds to human B cells in a dose-dependent manner, with a lower affinity as compared to CD19(2B11)×4-1BBL, while untargeted DP47×4-1BBL did not bind to B cells. FIG. 17B shows the binding of different 4-1BB×CD19 constructs to CD19+ WSU-DLCL2 cell lines, detected by the secondary antibody against human Fc. 4-1BB(20H4.9)×CD19(2B11) binds to CD19+ WSU tumor cells in a similar manner as to primary B cells. 4-1BB(20H4.9)×CD19(8B8-018) shows an identical binding property as compared to 4-1BB(20H4.9)× CD19(2B11).

Figure 18A:
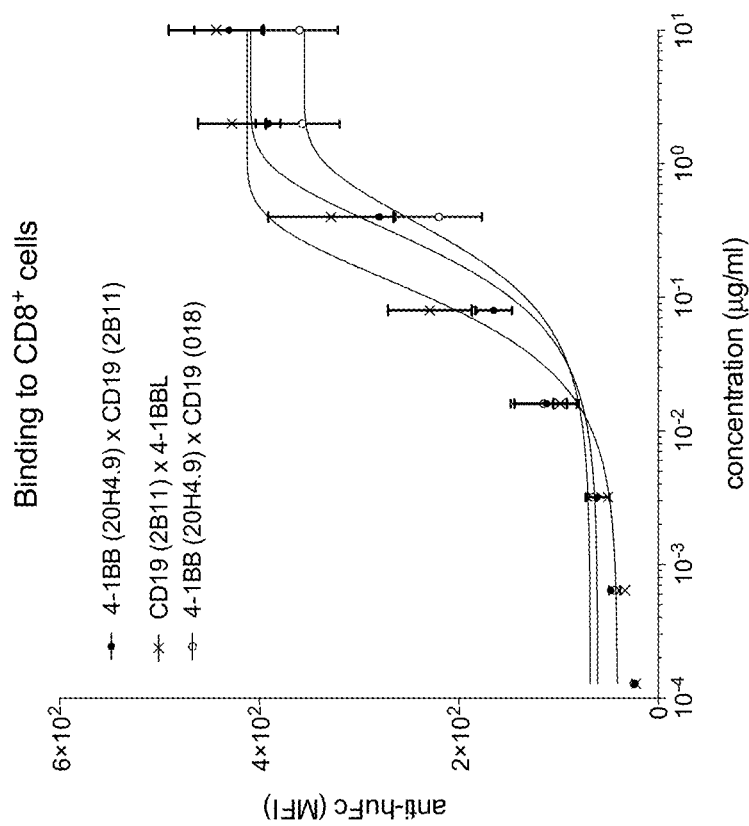
Figure 18B:
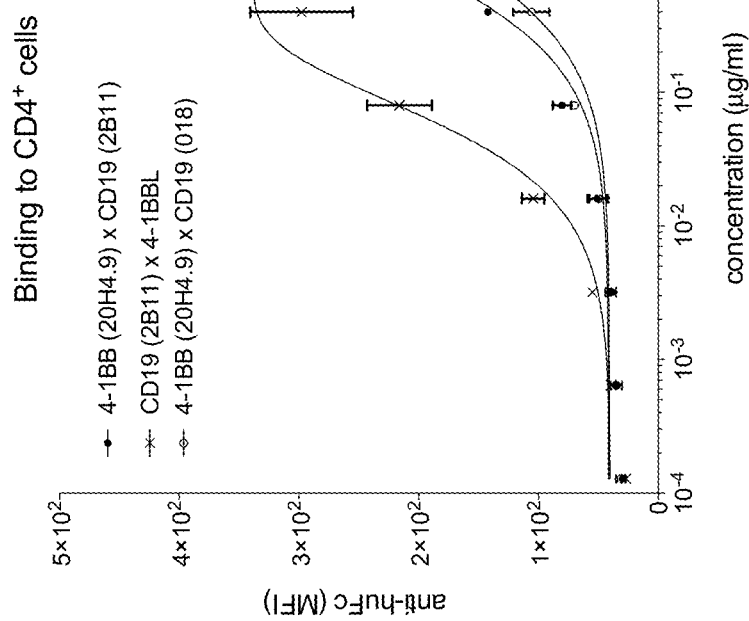

FIGS. 18A and 18B show the binding of 4-1BB×CD19 constructs to activated CD4+ T cells (FIG. 18A) or activated CD8+ T cells (FIG. 18B). The specific binding was gated on pure population of CD4 and CD8 cells. 4-1BB(20H4.9)× CD19(2B11) showed excellent binding to 4-1BB expressing CD4 or CD8 T cells in a dose dependent manner, but with a slightly lower affinity as compared to CD19 (2B11)-4-1BBL. 4-1BB(20H4.9)×CD19(018) shows an identical binding property as compared to 4-1BB(20H4.9)×CD19 (2B11).

Figure 19:
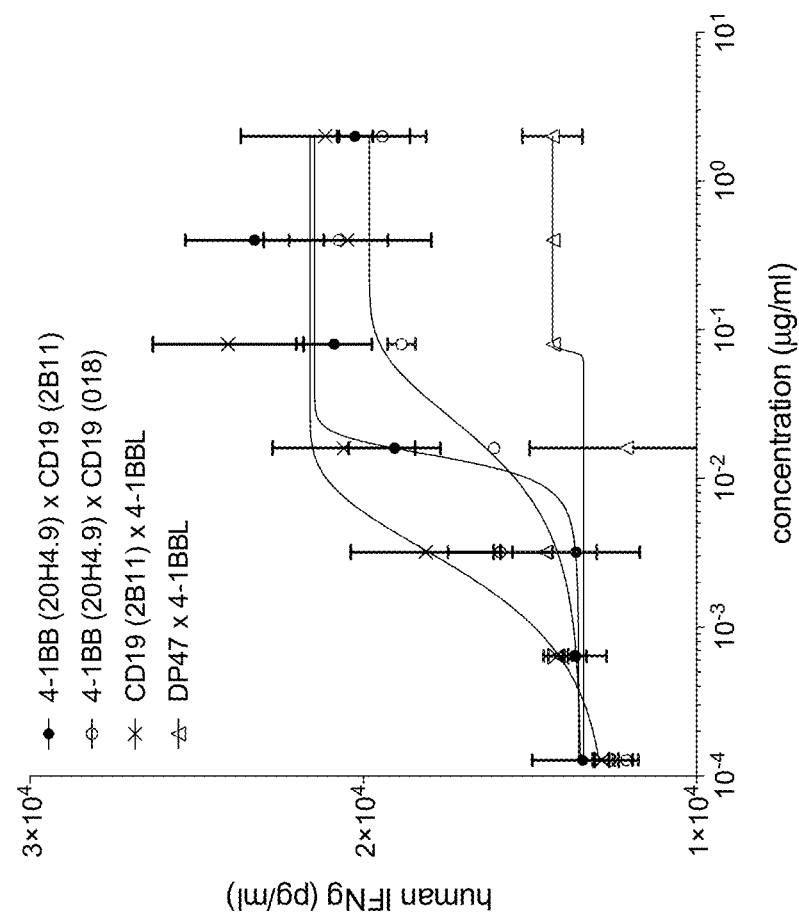

In FIG. 19 is shown the IFN-γ release by activated PBMCs caused by 4-1BB×CD19 constructs. Total human PBMCs were incubated with anti-CD3 and anti-CD28 microbeads and with a titrated concentration of 4-1BB× CD19 constructs. Two days later the supernatants were collected for the measurement of IFN-γ by ELISA.

Figure 20A:
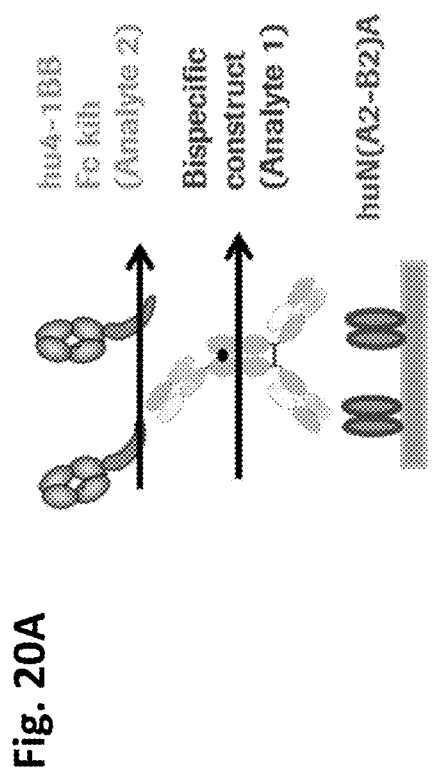
Figure 20C:
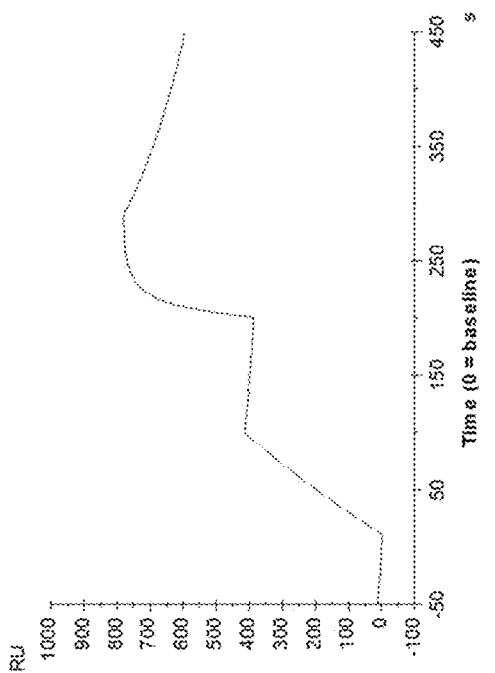
Figure 20B:
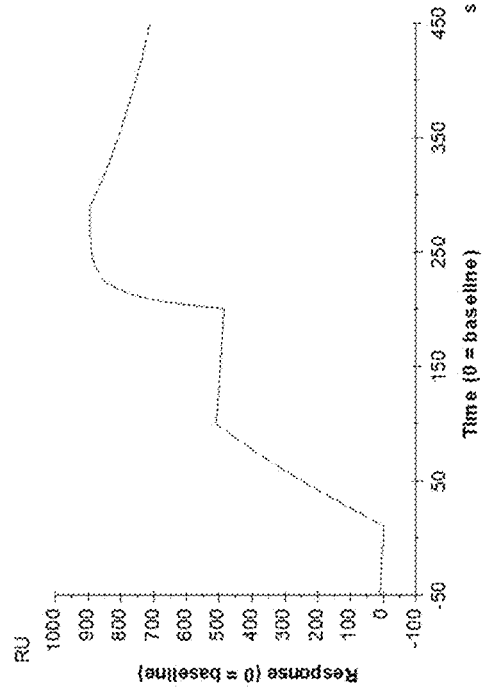

FIGS. 20A to 20C refer to the simultaneous binding of 2+1 bispecific agonistic 4-1BB antibodies with monovalent binding for CEA, in particular to the epitope region of antigen N(A2-B2)A, and hu4-1BB. FIG. 20A shows the setup of the assay. In FIG. 20B the simultaneous binding of the 2+1 4-1BB (20H4.9)/CEA(A5B7P) human IgG1 PGLALA construct with CHCL crossfab (Analyte 1) to immobilized N(A2-B2)A and human 4-1BB (Analyte 2) is shown. FIG. 20C shows the simultaneous binding of the 2+1 4-1BB (20H4.9)/CEA(A5B7P) human IgG1 PGLALA construct with VHVL crossfab (Analyte 1) to immobilized N(A2-B2)A and human 4-1BB (Analyte 2).

Figure 21D:
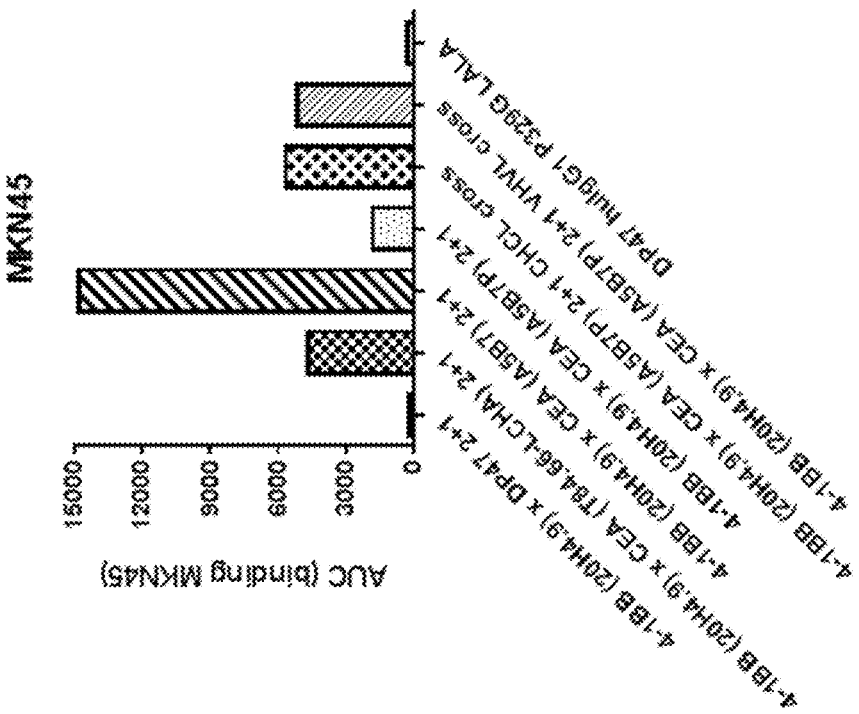
Figure 21C:
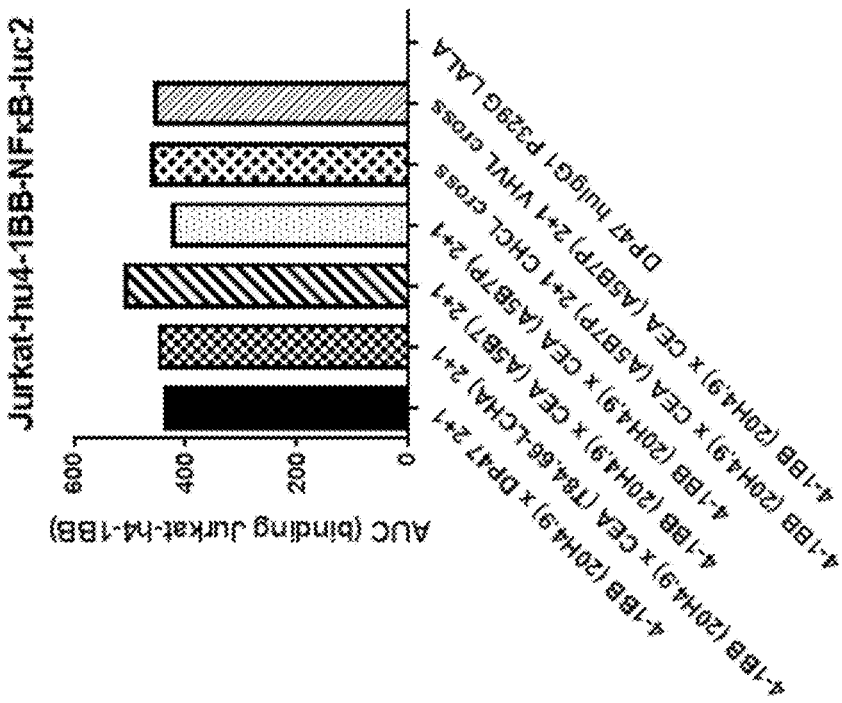

In FIGS. 21A to 21D the binding of bispecific molecules to human 4-1BB or human CEA-expressing cells is shown, respectively. The concentration of bispecific CEA and 4-1BB-binding molecules is blotted against the geo mean of fluorescence intensity (MFI) of the PE-conjugated secondary detection antibody. All values are baseline corrected by subtracting the baseline values of the blank control (e.g. no primary, only secondary detection antibody). In FIG. 21A binding to human 4-1BB-expressing reporter cell line Jurkat-hu4-1BB-NFκB-luc and in FIG. 21B binding to human CEA-expressing human gastric cancer cell line MKN45 are shown. Only antigen binding molecules comprising a 4-1BB antigen binding domain or CEA antigen binding domain bind efficiently to human 4-1BB-expressing Jurkat-hu4-1BB-NFκB-luc cells or human CEA-expressing MKN45 cells, respectively. As a negative control an unspecific DP47 huIgG P329G LALA antibody was used delivering the baseline. In FIG. 21C area under the curve (AUC) of binding curves to Jurkat-hu4-1BB-NFκB-luc and in FIG. 21D AUC of binding crves to MKN45 cells are shown.

Figure 22C:
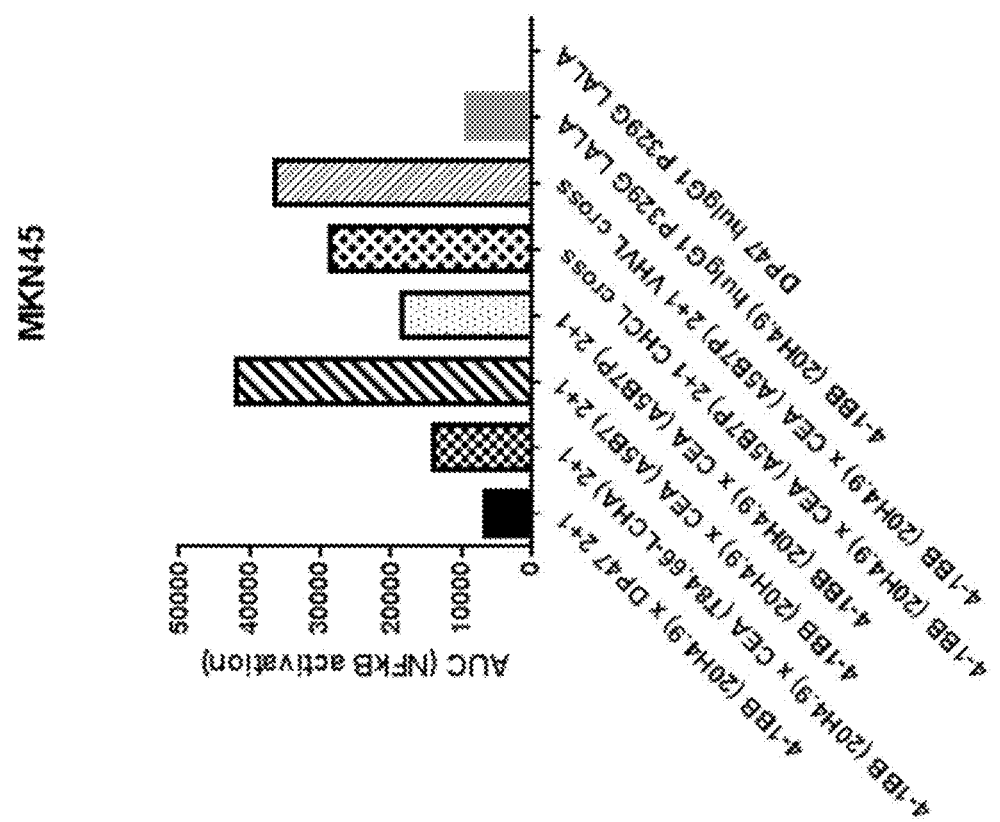

FIGS. 22A to 22C show the NFκB-mediated luciferase expression and therefore activity in 4-1BB expressing reporter cell line (Jurkat-hu4-1BB-NFkB-luc2). The concentrations of bispecific CEA-targeted agonistic 4-1BB-bispecific antibodies are blotted against the units of released light (URLs) measured after 6 h of incubation. All values are baseline corrected by subtracting the baseline values of the blank control (e.g. no antibodies added). In FIG. 22A CEA-target-independent 4-1BB activation is shown, whereby 4-1BB-binding induces NFκB-controlled luciferase expression in the reporter cell line without any CEA-mediated crosslinking. In FIG. 22B CEA surface-expressing human gastric adenocarcinoma cell line MKN45 was added in a ratio 5:1 to the reporter cell line. The CEA-expressing MKN45 cells lead to a crosslinking of the bispecific 4-1BB and CEA antigen binding molecules and increased its potential to induce NFκB-induced luciferase activation in the 4-1BB-expressing reporter cell line. Dependent on the CEA-targeting clone and bispecific format, the molecules displayed different activation potential. Clone A5B7P has been used in three different formats, whereby C-terminal VH/VL fusion of the A5B7P clone (grey triangle) shows less activity as the bispecific formats, where the A5B7P was fused C-terminally as CH/CL crossFab (black diamond). The highest activation potential was seen if A5B7P was fused C-terminal as VH/VL crossFab (black open square). Therefore clone A5B7P underlies format restrictions leading to different activation potential. The strongest activation is seen with CEA-binder clone A5B7 (black down facing triangle). Untargeted 4-1BB (20H4.9) molecules like 4-1BB (20H4.9)×DP47 2+1 (open grey circle, dotted line) or 4-1BB (20H4.9) huIgG1 P329G LALA (grey filled circle) show a CEA-crosslinking independent baseline activity. Calculated AUC are summarized in FIG. 22C. Used CEA-binding clones and formats are indicated at the X-Axis and as pictures above the columns.

In FIGS. 23A to 23D human PBMC activation in the presence of CEA-expressed tumor cells (MKN45) is shown. Incubation of fresh isolated human PBMCs in the presence of CEA-expressing MKN45 cells and a CD3 stimulus leads to a upregulation of CD25 on CD4+ T cells (FIG. 23A) and CD8+ T cells (FIG. 23B) as well as to an increased proliferation of CD4+ T cells (FIG. 23C) and to a lesser extent of CD8+ T cells (FIG. 23D) if CEA-targeted 4-1BB (20H4.9) antigen binding molecule (black filled triangle and line) is present. The non-CEA-targeted 4-1BB (20H4.9)×DP47 2+1 (grey open circle, dotted line) or 4-1BB (20H4.9) huIgG1 P329G LALA (filled grey circle, filled line) molecules gave only a limited baseline activation whereas DP47 huIgG1 P329G LALA as negative control delivered a true baseline.

In FIGS. 24A to 24D human PBMC from a different donor as shown in FIGS. 23A to 23D were activated in the presence of CEA-expressed tumor cells (MKN45). Incubation of fresh isolated human PBMCs in the presence of CEA-expressing cells and a CD3 stimulus leads to a upregulation of CD25 on CD4$^+$ T cells (FIG. 24A) and CD8$^+$ T cells (FIG. 24B) as well as to an increased proliferation of CD4$^+$ T cells (FIG. 24C) and to a lesser extent of CD8$^+$ T cells (FIG. 24D) if CEA-targeted 4-1BB (20H4.9) antigen binding molecules were present.

DETAILED DESCRIPTION OF THE INVENTION

Definitions

Unless defined otherwise, technical and scientific terms used herein have the same meaning as generally used in the art to which this invention belongs. For purposes of interpreting this specification, the following definitions will apply and whenever appropriate, terms used in the singular will also include the plural and vice versa.

As used herein, the term "antigen binding molecule" refers in its broadest sense to a molecule that specifically binds an antigenic determinant. Examples of antigen binding molecules are antibodies, antibody fragments and scaffold antigen binding proteins.

As used herein, the term "antigen binding domain capable of specific binding to a target cell antigen" or "moiety capable of specific binding to a target cell antigen" refers to a polypeptide molecule that specifically binds to an antigenic determinant. In one aspect, the antigen binding domain is able to activate signaling through its target cell antigen. In a particular aspect, the antigen binding domain is able to direct the entity to which it is attached (e.g. the 4-1BB agonist) to a target site, for example to a specific type of tumor cell or tumor stroma bearing the antigenic determinant. Antigen binding domains capable of specific binding to a target cell antigen include antibodies and fragments thereof as further defined herein. In addition, antigen binding domains capable of specific binding to a target cell antigen include scaffold antigen binding proteins as further defined herein, e.g. binding domains which are based on designed repeat proteins or designed repeat domains (see e.g. WO 2002/020565).

In relation to an antibody or fragment thereof, the term "antigen binding domain capable of specific binding to a target cell antigen" refers to the part of the molecule that comprises the area which specifically binds to and is complementary to part or all of an antigen. A antigen binding domain capable of specific antigen binding may be provided, for example, by one or more antibody variable domains (also called antibody variable regions). Particularly, an antigen binding domain capable of specific antigen binding comprises an antibody light chain variable region (VL) and an antibody heavy chain variable region (VH). In another aspect, the "antigen binding domain capable of specific binding to a target cell antigen" can also be a Fab fragment or a cross-Fab fragment.

The term "antibody" herein is used in the broadest sense and encompasses various antibody structures, including but not limited to monoclonal antibodies, polyclonal antibodies, monospecific and multispecific antibodies (e.g., bispecific antibodies), and antibody fragments so long as they exhibit the desired antigen-binding activity.

The term "monoclonal antibody" as used herein refers to an antibody obtained from a population of substantially homogeneous antibodies, i.e., the individual antibodies comprising the population are identical and/or bind the same epitope, except for possible variant antibodies, e.g. containing naturally occurring mutations or arising during production of a monoclonal antibody preparation, such variants generally being present in minor amounts. In contrast to polyclonal antibody preparations, which typically include different antibodies directed against different determinants (epitopes), each monoclonal antibody of a monoclonal antibody preparation is directed against a single determinant on an antigen.

The term "monospecific" antibody as used herein denotes an antibody that has one or more binding sites each of which bind to the same epitope of the same antigen. The term "bispecific" means that the antigen binding molecule is able to specifically bind to at least two distinct antigenic determinants. Typically, a bispecific antigen binding molecule comprises two antigen binding sites, each of which is specific for a different antigenic determinant. In certain embodiments the bispecific antigen binding molecule is capable of simultaneously binding two antigenic determinants, particularly two antigenic determinants expressed on two distinct cells.

The term "valent" as used within the current application denotes the presence of a specified number of binding sites specific for one distinct antigenic determinant in an antigen binding molecule that are specific for one distinct antigenic determinant. As such, the terms "bivalent", "tetravalent", and "hexavalent" denote the presence of two binding sites, four binding sites, and six binding sites specific for a certain antigenic determinant, respectively, in an antigen binding molecule. In particular aspects of the invention, the bispecific antigen binding molecules according to the invention can be monovalent for a certain antigenic determinant, meaning that they have only one binding site for said antigenic determinant or they can be bivalent or tetravalent for a certain antigenic determinant, meaning that they have two binding sites or four binding sites, respectively, for said antigenic determinant.

The terms "full length antibody", "intact antibody", and "whole antibody" are used herein interchangeably to refer to an antibody having a structure substantially similar to a native antibody structure. "Native antibodies" refer to naturally occurring immunoglobulin molecules with varying structures. For example, native IgG-class antibodies are heterotetrameric glycoproteins of about 150,000 daltons, composed of two light chains and two heavy chains that are disulfide-bonded. From N- to C-terminus, each heavy chain has a variable region (VH), also called a variable heavy domain or a heavy chain variable domain, followed by three constant domains (CH1, CH2, and CH3), also called a heavy chain constant region. Similarly, from N- to C-terminus, each light chain has a variable region (VL), also called a variable light domain or a light chain variable domain, followed by a light chain constant domain (CL), also called a light chain constant region. The heavy chain of an antibody may be assigned to one of five types, called α (IgA), δ (IgD), ε (IgE), γ (IgG), or μ (IgM), some of which may be further divided into subtypes, e.g. γ1 (IgG1), γ2 (IgG2), γ3 (IgG3), γ4 (IgG4), α1 (IgA1) and α2 (IgA2). The light chain of an antibody may be assigned to one of two types, called kappa (κ) and lambda (λ), based on the amino acid sequence of its constant domain.

An "antibody fragment" refers to a molecule other than an intact antibody that comprises a portion of an intact antibody that binds the antigen to which the intact antibody binds. Examples of antibody fragments include but are not limited to Fv, Fab, Fab', Fab'-SH, F(ab')$_2$; diabodies, triabodies, tetrabodies, cross-Fab fragments; linear antibodies; single-chain antibody molecules (e.g. scFv); and single domain antibodies. For a review of certain antibody fragments, see Hudson et al., Nat Med 9, 129-134 (2003). For a review of scFv fragments, see e.g. Plückthun, in The Pharmacology of Monoclonal Antibodies, vol. 113, Rosenburg and Moore eds., Springer-Verlag, New York, pp. 269-315 (1994); see also WO 93/16185; and U.S. Pat. Nos. 5,571,894 and 5,587,458. For discussion of Fab and F(ab')2 fragments comprising salvage receptor binding epitope residues and having increased in vivo half-life, see U.S. Pat. No. 5,869, 046. Diabodies are antibody fragments with two antigen-binding sites that may be bivalent or bispecific, see, for example, EP 404,097; WO 1993/01161; Hudson et al., Nat Med 9, 129-134 (2003); and Hollinger et al., Proc Natl Acad Sci USA 90, 6444-6448 (1993). Triabodies and tetrabodies are also described in Hudson et al., Nat Med 9, 129-134 (2003). Single-domain antibodies are antibody fragments comprising all or a portion of the heavy chain variable domain or all or a portion of the light chain variable domain of an antibody. In certain embodiments, a single-domain antibody is a human single-domain antibody (Domantis, Inc., Waltham, Mass.; see e.g. U.S. Pat. No. 6,248,516 B1). Antibody fragments can be made by various techniques, including but not limited to proteolytic digestion of an intact antibody as well as production by recombinant host cells (e.g. E. coli or phage), as described herein.

Papain digestion of intact antibodies produces two identical antigen-binding fragments, called "Fab" fragments containing each the heavy- and light-chain variable domains and also the constant domain of the light chain and the first constant domain (CH1) of the heavy chain. As used herein, Thus, the term "Fab fragment" refers to an antibody fragment comprising a light chain fragment comprising a VL domain and a constant domain of a light chain (CL), and a VH domain and a first constant domain (CH1) of a heavy chain. Fab' fragments differ from Fab fragments by the addition of a few residues at the carboxy terminus of the heavy chain CH1 domain including one or more cysteins from the antibody hinge region. Fab'-SH are Fab' fragments wherein the cysteine residue(s) of the constant domains bear a free thiol group. Pepsin treatment yields an F(ab')$_2$ fragment that has two antigen-combining sites (two Fab fragments) and a part of the Fc region. According to the present invention, the term "Fab fragment" also includes "cross-Fab fragments" or "crossover Fab fragments" as defined below.

The term "cross-Fab fragment" or "xFab fragment" or "crossover Fab fragment" refers to a Fab fragment, wherein either the variable regions or the constant regions of the heavy and light chain are exchanged. Two different chain compositions of a cross-Fab molecule are possible and comprised in the bispecific antibodies of the invention: On the one hand, the variable regions of the Fab heavy and light chain are exchanged, i.e. the crossover Fab molecule comprises a peptide chain composed of the light chain variable region (VL) and the heavy chain constant region (CH1), and a peptide chain composed of the heavy chain variable region (VH) and the light chain constant region (CL). This crossover Fab molecule is also referred to as CrossFab (VLVH). On the other hand, when the constant regions of the Fab heavy and light chain are exchanged, the crossover Fab molecule comprises a peptide chain composed of the heavy chain variable region (VH) and the light chain constant region (CL), and a peptide chain composed of the light chain variable region (VL) and the heavy chain constant region (CH1). This crossover Fab molecule is also referred to as CrossFab (CLCH1).

A "single chain Fab fragment" or "scFab" is a polypeptide consisting of an antibody heavy chain variable domain (VH), an antibody constant domain 1 (CH1), an antibody light chain variable domain (VL), an antibody light chain constant domain (CL) and a linker, wherein said antibody domains and said linker have one of the following orders in N-terminal to C-terminal direction: a) VH-CH1-linker-VL-CL, b) VL-CL-linker-VH-CH1, c) VH-CL-linker-VL-CH1 or d) VL-CH1-linker-VH-CL; and wherein said linker is a polypeptide of at least 30 amino acids, preferably between 32 and 50 amino acids. Said single chain Fab fragments are stabilized via the natural disulfide bond between the CL domain and the CH1 domain. In addition, these single chain Fab molecules might be further stabilized by generation of interchain disulfide bonds via insertion of cysteine residues (e.g. position 44 in the variable heavy chain and position 100 in the variable light chain according to Kabat numbering).

A "crossover single chain Fab fragment" or "x-scFab" is a is a polypeptide consisting of an antibody heavy chain variable domain (VH), an antibody constant domain 1 (CH1), an antibody light chain variable domain (VL), an antibody light chain constant domain (CL) and a linker, wherein said antibody domains and said linker have one of the following orders in N-terminal to C-terminal direction: a) VH-CL-linker-VL-CH1 and b) VL-CH1-linker-VH-CL; wherein VH and VL form together an antigen-binding site which binds specifically to an antigen and wherein said linker is a polypeptide of at least 30 amino acids. In addition, these x-scFab molecules might be further stabilized by generation of interchain disulfide bonds via insertion of cysteine residues (e.g. position 44 in the variable heavy chain and position 100 in the variable light chain according to Kabat numbering).

A "single-chain variable fragment (scFv)" is a fusion protein of the variable regions of the heavy ($V_H$) and light chains ($V_L$) of an antibody, connected with a short linker peptide of ten to about 25 amino acids. The linker is usually rich in glycine for flexibility, as well as serine or threonine for solubility, and can either connect the N-terminus of the $V_H$ with the C-terminus of the $V_L$, or vice versa. This protein retains the specificity of the original antibody, despite removal of the constant regions and the introduction of the linker. scFv antibodies are, e.g. described in Houston, J. S., Methods in Enzymol. 203 (1991) 46-96). In addition, antibody fragments comprise single chain polypeptides having the characteristics of a VH domain, namely being able to assemble together with a VL domain, or of a VL domain, namely being able to assemble together with a VH domain to a functional antigen binding site and thereby providing the antigen binding property of full length antibodies.

"Scaffold antigen binding proteins" are known in the art, for example, fibronectin and designed ankyrin repeat proteins (DARPins) have been used as alternative scaffolds for antigen-binding domains, see, e.g., Gebauer and Skerra, Engineered protein scaffolds as next-generation antibody therapeutics. Curr Opin Chem Biol 13:245-255 (2009) and Stumpp et al., Darpins: A new generation of protein therapeutics. Drug Discovery Today 13: 695-701 (2008). In one aspect of the invention, a scaffold antigen binding protein is selected from the group consisting of CTLA-4 (Evibody), Lipocalins (Anticalin), a Protein A-derived molecule such as Z-domain of Protein A (Affibody), an A-domain (Avimer/Maxibody), a serum transferrin (trans-body); a designed ankyrin repeat protein (DARPin), a variable domain of antibody light chain or heavy chain (single-domain antibody, sdAb), a variable domain of antibody heavy chain (nanobody, aVH), $V_{NAR}$ fragments, a fibronectin (AdNectin), a C-type lectin domain (Tetranectin); a variable domain of a new antigen receptor beta-lactamase ($V_{NAR}$ fragments), a human gamma-crystallin or ubiquitin (Affilin molecules); a kunitz type domain of human protease inhibitors, microbodies such as the proteins from the knottin family, peptide aptamers and fibronectin (adnectin). CTLA-4 (Cytotoxic T Lymphocyte-associated Antigen 4) is a CD28-family receptor expressed on mainly CD4$^+$ T-cells. Its extracellular domain has a variable domain-like Ig fold. Loops corresponding to CDRs of antibodies can be substituted with heterologous sequence to confer different binding properties. CTLA-4 molecules engineered to have different binding specificities are also known as Evibodies (e.g. U.S. Pat. No. 7,166,697B1). Evibodies are around the same size as the isolated variable region of an antibody (e.g. a domain antibody). For further details see Journal of Immunological Methods 248 (1-2), 31-45 (2001). Lipocalins are a family of extracellular proteins which transport small hydrophobic molecules such as steroids, bilins, retinoids and lipids. They have a rigid beta-sheet secondary structure with a number of loops at the open end of the conical structure which can be engineered to bind to different target antigens. Anticalins are between 160-180 amino acids in size, and are derived from lipocalins. For further details see Biochim Biophys Acta 1482: 337-350 (2000), U.S. Pat. No. 7,250,297B1 and US20070224633. An affibody is a scaffold derived from Protein A of Staphylococcus aureus which can be engineered to bind to antigen. The domain consists of a three-helical bundle of approximately 58 amino acids. Libraries have been generated by randomization of surface residues. For further details see Protein Eng. Des. Sel. 2004, 17, 455-462 and EP 1641818A1. Avimers are multidomain proteins derived from the A-domain scaffold family. The native domains of approximately 35 amino acids adopt a defined disulfide bonded structure. Diversity is generated by shuffling of the natural variation exhibited by the family of A-domains. For further details see Nature Biotechnology 23(12), 1556-1561 (2005) and Expert Opinion on Investigational Drugs 16(6), 909-917 (June 2007). A transferrin is a monomeric serum transport glycoprotein. Transferrins can be engineered to bind different target antigens by insertion of peptide sequences in a permissive surface loop. Examples of engineered transferrin scaffolds include the Trans-body. For further details see J. Biol. Chem 274, 24066-24073 (1999). Designed Ankyrin Repeat Proteins (DARPins) are derived from Ankyrin which is a family of proteins that mediate attachment of integral membrane proteins to the cytoskeleton. A single ankyrin repeat is a 33 residue motif consisting of two alpha-helices and a beta-turn. They can be engineered to bind different target antigens by randomizing residues in the first alpha-helix and a beta-turn of each repeat. Their binding interface can be increased by increasing the number of modules (a method of affinity maturation). For further details see J. Mol. Biol. 332, 489-503 (2003), PNAS 100(4), 1700-1705 (2003) and J. Mol. Biol. 369, 1015-1028 (2007) and US20040132028A1. A single-domain antibody is an antibody fragment consisting of a single monomeric variable antibody domain. The first single domains were derived from the variable domain of the antibody heavy chain from camelids (nanobodies or $V_HH$ fragments). Furthermore, the term single-domain antibody includes an autonomous human heavy chain variable domain (aVH) or $V_{NAR}$ fragments derived from sharks. Fibronectin is a scaffold which can be engineered to bind to antigen. Adnectins consists of a backbone of the natural amino acid sequence of the 10th domain of the 15 repeating units of human fibronectin type III (FN3). Three loops at one end of the .beta.-sandwich can be engineered to enable an Adnectin to specifically recognize a therapeutic target of interest. For further details see Protein Eng. Des. Sel. 18, 435-444 (2005), US20080139791, WO2005056764 and U.S. Pat. No. 6,818,418B1. Peptide aptamers are combinatorial recognition molecules that consist of a constant scaffold protein, typically thioredoxin (TrxA) which contains a constrained variable peptide loop inserted at the active site. For further details see Expert Opin. Biol. Ther. 5, 783-797 (2005). Microbodies are derived from naturally occurring microproteins of 25-50 amino acids in length which contain 3-4 cysteine bridges—examples of microproteins include KalataBI and conotoxin and knottins. The microproteins have a loop which can beengineered to include up to 25 amino acids without affecting the overall fold of the microprotein. For further details of engineered knottin domains, see WO2008098796.

An "antigen binding molecule that binds to the same epitope" as a reference molecule refers to an antigen binding molecule that blocks binding of the reference molecule to its antigen in a competition assay by 50% or more, and conversely, the reference molecule blocks binding of the antigen binding molecule to its antigen in a competition assay by 50% or more.

The term "antigen binding domain" or "antigen-binding site" refers to the part of an antigen binding molecule that comprises the area which specifically binds to and is complementary to part or all of an antigen. Where an antigen is large, an antigen binding molecule may only bind to a particular part of the antigen, which part is termed an epitope. An antigen binding domain may be provided by, for example, one or more variable domains (also called variable regions). Preferably, an antigen binding domain comprises an antibody light chain variable region (VL) and an antibody heavy chain variable region (VH).

As used herein, the term "antigenic determinant" is synonymous with "antigen" and "epitope," and refers to a site (e.g. a contiguous stretch of amino acids or a conformational configuration made up of different regions of non-contiguous amino acids) on a polypeptide macromolecule to which an antigen binding moiety binds, forming an antigen binding moiety-antigen complex. Useful antigenic determinants can be found, for example, on the surfaces of tumor cells, on the surfaces of virus-infected cells, on the surfaces of other diseased cells, on the surface of immune cells, free in blood serum, and/or in the extracellular matrix (ECM). The proteins useful as antigens herein can be any native form the proteins from any vertebrate source, including mammals such as primates (e.g. humans) and rodents (e.g. mice and rats), unless otherwise indicated. In a particular embodiment the antigen is a human protein. Where reference is made to a specific protein herein, the term encompasses the "full-length", unprocessed protein as well as any form of the protein that results from processing in the cell. The term also encompasses naturally occurring variants of the protein, e.g. splice variants or allelic variants.

By "specific binding" is meant that the binding is selective for the antigen and can be discriminated from unwanted or non-specific interactions. The ability of an antigen binding molecule to bind to a specific antigen can be measured either through an enzyme-linked immunosorbent assay (ELISA) or other techniques familiar to one of skill in the art, e.g. Surface Plasmon Resonance (SPR) technique (analyzed on a BIAcore instrument) (Liljeblad et al., Glyco J 17, 323-329 (2000)), and traditional binding assays (Heeley, Endocr Res 28, 217-229 (2002)). In one embodiment, the extent of binding of an antigen binding molecule to an unrelated protein is less than about 10% of the binding of the antigen binding molecule to the antigen as measured, e.g. by SPR. In certain embodiments, an molecule that binds to the antigen has a dissociation constant (Kd) of ≤1 μM, ≤100 nM, ≤10 nM, ≤1 nM, ≤0.1 nM, ≤0.01 nM, or ≤0.001 nM (e.g. $10^{-8}$ M or less, e.g. from $10^{-8}$ M to $10^{-13}$ M, e.g. from $10^{-9}$ M to $10^{-13}$ M).

"Affinity" or "binding affinity" refers to the strength of the sum total of non-covalent interactions between a single binding site of a molecule (e.g. an antibody) and its binding partner (e.g. an antigen). Unless indicated otherwise, as used herein, "binding affinity" refers to intrinsic binding affinity which reflects a 1:1 interaction between members of a binding pair (e.g. antibody and antigen). The affinity of a molecule X for its partner Y can generally be represented by the dissociation constant (Kd), which is the ratio of dissociation and association rate constants (koff and kon, respectively). Thus, equivalent affinities may comprise different rate constants, as long as the ratio of the rate constants remains the same. Affinity can be measured by common methods known in the art, including those described herein. A particular method for measuring affinity is Surface Plasmon Resonance (SPR).

An "affinity matured" antibody refers to an antibody with one or more alterations in one or more hypervariable regions (HVRs), compared to a parent antibody which does not possess such alterations, such alterations resulting in an improvement in the affinity of the antibody for antigen.

A "target cell antigen" as used herein refers to an antigenic determinant presented on the surface of a target cell, for example a cell in a tumor such as a cancer cell or a cell of the tumor stroma. In certain embodiments, the target cell antigen is an antigen on the surface of a tumor cell. In one embodiment, target cell antigen is selected from the group consisting of Fibroblast Activation Protein (FAP), Carcinoembryonic Antigen (CEA), Melanoma-associated Chondroitin Sulfate Proteoglycan (MCSP), Epidermal Growth Factor Receptor (EGFR), CD19, CD20 and CD33. In particular, the target cell antigen is Fibroblast Activation Protein (FAP).

The term "Fibroblast activation protein (FAP)", also known as Prolyl endopeptidase FAP or Seprase (EC 3.4.21), refers to any native FAP from any vertebrate source, including mammals such as primates (e.g. humans) non-human primates (e.g. cynomolgus monkeys) and rodents (e.g. mice and rats), unless otherwise indicated. The term encompasses "full-length," unprocessed FAP as well as any form of FAP that results from processing in the cell. The term also encompasses naturally occurring variants of FAP, e.g., splice variants or allelic variants. In one embodiment, the antigen binding molecule of the invention is capable of specific binding to human, mouse and/or cynomolgus FAP. The amino acid sequence of human FAP is shown in UniProt (www.uniprot.org) accession no. Q12884 (version 149, SEQ ID NO:95), or NCBI (www.ncbi.nlm.nih.gov/) RefSeq NP_004451.2. The extracellular domain (ECD) of human FAP extends from amino acid position 26 to 760. The amino acid sequence of a His-tagged human FAP ECD is shown in SEQ ID NO 96. The amino acid sequence of mouse FAP is shown in UniProt accession no. P97321 (version 126, SEQ ID NO:97), or NCBI RefSeq NP_032012.1. The extracellular domain (ECD) of mouse FAP extends from amino acid position 26 to 761. SEQ ID NO: 98 shows the amino acid sequence of a His-tagged mouse FAP ECD. SEQ ID NO: 99 shows the amino acid sequence of a His-tagged cynomolgus FAP ECD. Preferably, an anti-FAP binding molecule of the invention binds to the extracellular domain of FAP.

The term "Carcinoembroynic antigen (CEA)", also known as Carcinoembryonic antigen-related cell adhesion molecule 5 (CEACAM5), refers to any native CEA from any vertebrate source, including mammals such as primates (e.g. humans) non-human primates (e.g. cynomolgus monkeys) and rodents (e.g. mice and rats), unless otherwise indicated. The amino acid sequence of human CEA is shown in UniProt accession no. P06731 (version 151, SEQ ID NO:100). CEA has long been identified as a tumor-associated antigen (Gold and Freedman, J Exp Med., 121:439-462, 1965; Berinstein N. L., J Clin Oncol., 20:2197-2207, 2002). Originally classified as a protein expressed only in fetal tissue, CEA has now been identified in several normal adult tissues. These tissues are primarily epithelial in origin, including cells of the gastrointestinal, respiratory, and urogential tracts, and cells of colon, cervix, sweat glands, and prostate (Nap et al., Tumour Biol., 9(2-3):145-53, 1988; Nap et al., Cancer Res., 52(8):2329-23339, 1992). Tumors of epithelial origin, as well as their metastases, contain CEA as a tumor associated antigen. While the presence of CEA itself does not indicate transformation to a cancerous cell, the distribution of CEA is indicative. In normal tissue, CEA is generally expressed on the apical surface of the cell (Hammarstrom S., Semin Cancer Biol. 9(2):67-81 (1999)), making it inaccessible to antibody in the blood stream. In contrast to normal tissue, CEA tends to be expressed over the entire surface of cancerous cells (Hammarstrom S., Semin Cancer Biol. 9(2):67-81 (1999)). This change of expression pattern makes CEA accessible to antibody binding in cancerous cells. In addition, CEA expression increases in cancerous cells. Furthermore, increased CEA expression promotes increased intercellular adhesions, which may lead to metastasis (Marshall J., Semin Oncol., 30 (a Suppl. 8):30-6, 2003). The prevalence of CEA expression in various tumor entities is generally very high. In concordance with published data, own analyses performed in tissue samples confirmed its high prevalence, with approximately 95% in colorectal carcinoma (CRC), 90% in pancreatic cancer, 80% in gastric cancer, 60% in non-small cell lung cancer (NSCLC, where it is co-expressed with HERS), and 40% in breast cancer; low expression was found in small cell lung cancer and glioblastoma.

CEA is readily cleaved from the cell surface and shed into the blood stream from tumors, either directly or via the lymphatics. Because of this property, the level of serum CEA has been used as a clinical marker for diagnosis of cancers and screening for recurrence of cancers, particularly colorectal cancer (Goldenberg D M., The International Journal of Biological Markers, 7:183-188, 1992; Chau I., et al., J Clin Oncol., 22:1420-1429, 2004; Flamini et al., Clin Cancer Res; 12(23):6985-6988, 2006).

The term "Melanoma-associated Chondroitin Sulfate Proteoglycan (MCSP)", also known as Chondroitin Sulfate Proteoglycan 4 (CSPG4) refers to any native MCSP from any vertebrate source, including mammals such as primates (e.g. humans) non-human primates (e.g. cynomolgus monkeys) and rodents (e.g. mice and rats), unless otherwise indicated. The amino acid sequence of human MCSP is shown in UniProt accession no. Q6UVK1 (version 103, SEQ ID NO:101). The term "Epidermal Growth Factor Receptor (EGFR)", also named Proto-oncogene c-ErbB-1 or Receptor tyrosine-protein kinase erbB-1, refers to any native EGFR from any vertebrate source, including mammals such as primates (e.g. humans) non-human primates (e.g. cynomolgus monkeys) and rodents (e.g. mice and rats), unless otherwise indicated. The amino acid sequence of human EGFR is shown in UniProt accession no. P00533 (version 211, SEQ ID NO:102). The term "CD19" refers to B-lymphocyte antigen CD19, also known as B-lymphocyte surface antigen B4 or T-cell surface antigen Leu-12 and includes any native CD19 from any vertebrate source, including mammals such as primates (e.g. humans) non-human primates (e.g. cynomolgus monkeys) and rodents (e.g. mice and rats), unless otherwise indicated. The amino acid sequence of human CD19 is shown in Uniprot accession no. P15391 (version 160, SEQ ID NO:103). "CD20" refers to B-lymphocyte antigen CD20, also known as membrane-spanning 4-domains subfamily A member 1 (MS4A1), B-lymphocyte surface antigen B1 or Leukocyte surface antigen Leu-16, and includes any native CD20 from any vertebrate source, including mammals such as primates (e.g. humans) non-human primates (e.g. cynomolgus monkeys) and rodents (e.g. mice and rats), unless otherwise indicated. The amino acid sequence of human CD20 is shown in Uniprot accession no. P11836 (version 149, SEQ ID NO:104). "CD33" refers to Myeloid cell surface antigen CD33, also known as SIGLEC3 or gp67, and includes any native CD33 from any vertebrate source, including mammals such as primates (e.g. humans) non-human primates (e.g. cynomolgus monkeys) and rodents (e.g. mice and rats), unless otherwise indicated. The amino acid sequence of human CD33 is shown in Uniprot accession no. P20138 (version 157, SEQ ID NO:105).

The term "variable region" or "variable domain" refers to the domain of an antibody heavy or light chain that is involved in binding the antigen binding molecule to antigen. The variable domains of the heavy chain and light chain (VH and VL, respectively) of a native antibody generally have similar structures, with each domain comprising four conserved framework regions (FRs) and three hypervariable regions (HVRs). See, e.g., Kindt et al., Kuby Immunology, 6th ed., W.H. Freeman and Co., page 91 (2007). A single VH or VL domain may be sufficient to confer antigen-binding specificity.

The term "hypervariable region" or "HVR," as used herein refers to each of the regions of an antibody variable domain which are hypervariable in sequence and/or form structurally defined loops ("hypervariable loops"). Generally, native four-chain antibodies comprise six HVRs; three in the VH (H1, H2, H3), and three in the VL (L1, L2, L3). HVRs generally comprise amino acid residues from the hypervariable loops and/or from the "complementarity determining regions" (CDRs), the latter being of highest sequence variability and/or involved in antigen recognition. Exemplary hypervariable loops occur at amino acid residues 26-32 (L1), 50-52 (L2), 91-96 (L3), 26-32 (H1), 53-55 (H2), and 96-101 (H3). (Chothia and Lesk, J. Mol. Biol. 196:901-917 (1987).) Exemplary CDRs (CDR-L1, CDR-L2, CDR-L3, CDR-H1, CDR-H2, and CDR-H3) occur at amino acid residues 24-34 of L1, 50-56 of L2, 89-97 of L3, 31-35B of H1, 50-65 of H2, and 95-102 of H3. (Kabat et al., Sequences of Proteins of Immunological Interest, 5th Ed. Public Health Service, National Institutes of Health, Bethesda, Md. (1991).) Hypervariable regions (HVRs) are also referred to as complementarity determining regions (CDRs), and these terms are used herein interchangeably in reference to portions of the variable region that form the antigen binding regions. This particular region has been described by Kabat et al., U.S. Dept. of Health and Human Services, "Sequences of Proteins of Immunological Interest" (1983) and by Chothia et al., J. Mol. Biol. 196:901-917 (1987), where the definitions include overlapping or subsets of amino acid residues when compared against each other. Nevertheless, application of either definition to refer to a CDR of an antibody or variants thereof is intended to be within the scope of the term as defined and used herein. The appropriate amino acid residues which encompass the CDRs as defined by each of the above cited references are set forth below in Table A as a comparison. The exact residue numbers which encompass a particular CDR will vary depending on the sequence and size of the CDR. Those skilled in the art can routinely determine which residues comprise a particular CDR given the variable region amino acid sequence of the antibody.

TABLE A

CDR Definitions[1]

| CDR | Kabat | Chothia | AbM[2] |
|---|---|---|---|
| $V_H$ CDR1 | 31-35 | 26-32 | 26-35 |
| $V_H$ CDR2 | 50-65 | 52-58 | 50-58 |
| $V_H$ CDR3 | 95-102 | 95-102 | 95-102 |
| $V_L$ CDR1 | 24-34 | 26-32 | 24-34 |
| $V_L$ CDR2 | 50-56 | 50-52 | 50-56 |
| $V_L$ CDR3 | 89-97 | 91-96 | 89-97 |

[1]Numbering of all CDR definitions in Table A is according to the numbering conventions set forth by Kabat et al. (see below).
[2]"AbM" with a lowercase "b" as used in Table A refers to the CDRs as defined by Oxford Molecular's "AbM" antibody modeling software.

Kabat et al. also defined a numbering system for variable region sequences that is applicable to any antibody. One of ordinary skill in the art can unambiguously assign this system of "Kabat numbering" to any variable region sequence, without reliance on any experimental data beyond the sequence itself. As used herein, "Kabat numbering" refers to the numbering system set forth by Kabat et al., U.S. Dept. of Health and Human Services, "Sequence of Proteins of Immunological Interest" (1983). Unless otherwise specified, references to the numbering of specific amino acid residue positions in an antibody variable region are according to the Kabat numbering system.

With the exception of CDR1 in VH, CDRs generally comprise the amino acid residues that form the hypervariable loops. CDRs also comprise "specificity determining residues," or "SDRs," which are residues that contact antigen. SDRs are contained within regions of the CDRs called abbreviated-CDRs, or a-CDRs. Exemplary a-CDRs (a-CDR-L1, a-CDR-L2, a-CDR-L3, a-CDR-H1, a-CDR-H2, and a-CDR-H3) occur at amino acid residues 31-34 of L1, 50-55 of L2, 89-96 of L3, 31-35B of H1, 50-58 of H2, and 95-102 of H3. (See Almagro and Fransson, Front. Biosci. 13:1619-1633 (2008).) Unless otherwise indicated, HVR residues and other residues in the variable domain (e.g., FR residues) are numbered herein according to Kabat et al., supra.

"Framework" or "FR" refers to variable domain residues other than hypervariable region (HVR) residues. The FR of a variable domain generally consists of four FR domains: FR1, FR2, FR3, and FR4. Accordingly, the HVR and FR sequences generally appear in the following sequence in VH (or VL): FR1-H1(L1)-FR2-H2(L2)-FR3-H3 (L3)-FR4.

The term "chimeric" antibody refers to an antibody in which a portion of the heavy and/or light chain is derived from a particular source or species, while the remainder of the heavy and/or light chain is derived from a different source or species.

The "class" of an antibody refers to the type of constant domain or constant region possessed by its heavy chain.

There are five major classes of antibodies: IgA, IgD, IgE, IgG, and IgM, and several of these may be further divided into subclasses (isotypes), e.g. $IgG_1$, $IgG_2$, $IgG_3$, $IgG_4$, $IgA_1$, and $IgA_2$. The heavy chain constant domains that correspond to the different classes of immunoglobulins are called α, δ, ε, γ, and μ respectively.

A "humanized" antibody refers to a chimeric antibody comprising amino acid residues from non-human HVRs and amino acid residues from human FRs. In certain embodiments, a humanized antibody will comprise substantially all of at least one, and typically two, variable domains, in which all or substantially all of the HVRs (e.g., CDRs) correspond to those of a non-human antibody, and all or substantially all of the FRs correspond to those of a human antibody. A humanized antibody optionally may comprise at least a portion of an antibody constant region derived from a human antibody. A "humanized form" of an antibody, e.g., a non-human antibody, refers to an antibody that has undergone humanization. Other forms of "humanized antibodies" encompassed by the present invention are those in which the constant region has been additionally modified or changed from that of the original antibody to generate the properties according to the invention, especially in regard to C1q binding and/or Fc receptor (FcR) binding.

A "human" antibody is one which possesses an amino acid sequence which corresponds to that of an antibody produced by a human or a human cell or derived from a non-human source that utilizes human antibody repertoires or other human antibody-encoding sequences. This definition of a human antibody specifically excludes a humanized antibody comprising non-human antigen-binding residues.

The term "Fc domain" or "Fc region" herein is used to define a C-terminal region of an antibody heavy chain that contains at least a portion of the constant region. The term includes native sequence Fc regions and variant Fc regions. An IgG Fc region comprises an IgG CH2 and an IgG CH3 domain. The "CH2 domain" of a human IgG Fc region usually extends from an amino acid residue at about position 231 to an amino acid residue at about position 340. In one embodiment, a carbohydrate chain is attached to the CH2 domain. The CH2 domain herein may be a native sequence CH2 domain or variant CH2 domain. The "CH3 domain" comprises the stretch of residues C-terminal to a CH2 domain in an Fc region (i.e. from an amino acid residue at about position 341 to an amino acid residue at about position 447 of an IgG). The CH3 region herein may be a native sequence CH3 domain or a variant CH3 domain (e.g. a CH3 domain with an introduced "protuberance" ("knob") in one chain thereof and a corresponding introduced "cavity" ("hole") in the other chain thereof; see U.S. Pat. No. 5,821,333, expressly incorporated herein by reference). Such variant CH3 domains may be used to promote heterodimerization of two non-identical antibody heavy chains as herein described. In one embodiment, a human IgG heavy chain Fc region extends from Cys226, or from Pro230, to the carboxyl-terminus of the heavy chain. However, the C-terminal lysine (Lys447) of the Fc region may or may not be present. Unless otherwise specified herein, numbering of amino acid residues in the Fc region or constant region is according to the EU numbering system, also called the EU index, as described in Kabat et al., Sequences of Proteins of Immunological Interest, 5th Ed. Public Health Service, National Institutes of Health, Bethesda, Md., 1991.

The "knob-into-hole" technology is described e.g. in U.S. Pat. Nos. 5,731,168; 7,695,936; Ridgway et al., Prot Eng 9, 617-621 (1996) and Carter, J Immunol Meth 248, 7-15 (2001). Generally, the method involves introducing a protuberance ("knob") at the interface of a first polypeptide and a corresponding cavity ("hole") in the interface of a second polypeptide, such that the protuberance can be positioned in the cavity so as to promote heterodimer formation and hinder homodimer formation. Protuberances are constructed by replacing small amino acid side chains from the interface of the first polypeptide with larger side chains (e.g. tyrosine or tryptophan). Compensatory cavities of identical or similar size to the protuberances are created in the interface of the second polypeptide by replacing large amino acid side chains with smaller ones (e.g. alanine or threonine). The protuberance and cavity can be made by altering the nucleic acid encoding the polypeptides, e.g. by site-specific mutagenesis, or by peptide synthesis. In a specific embodiment a knob modification comprises the amino acid substitution T366W in one of the two subunits of the Fc domain, and the hole modification comprises the amino acid substitutions T366S, L368A and Y407V in the other one of the two subunits of the Fc domain. In a further specific embodiment, the subunit of the Fc domain comprising the knob modification additionally comprises the amino acid substitution S354C, and the subunit of the Fc domain comprising the hole modification additionally comprises the amino acid substitution Y349C. Introduction of these two cysteine residues results in the formation of a disulfide bridge between the two subunits of the Fc region, thus further stabilizing the dimer (Carter, J Immunol Methods 248, 7-15 (2001)).

A "region equivalent to the Fc region of an immunoglobulin" is intended to include naturally occurring allelic variants of the Fc region of an immunoglobulin as well as variants having alterations which produce substitutions, additions, or deletions but which do not decrease substantially the ability of the immunoglobulin to mediate effector functions (such as antibody-dependent cellular cytotoxicity). For example, one or more amino acids can be deleted from the N-terminus or C-terminus of the Fc region of an immunoglobulin without substantial loss of biological function. Such variants can be selected according to general rules known in the art so as to have minimal effect on activity (see, e.g., Bowie, J. U. et al., Science 247:1306-10 (1990)).

The term "effector functions" refers to those biological activities attributable to the Fc region of an antibody, which vary with the antibody isotype. Examples of antibody effector functions include: C1q binding and complement dependent cytotoxicity (CDC), Fc receptor binding, antibody-dependent cell-mediated cytotoxicity (ADCC), antibody-dependent cellular phagocytosis (ADCP), cytokine secretion, immune complex-mediated antigen uptake by antigen presenting cells, down regulation of cell surface receptors (e.g. B cell receptor), and B cell activation.

Fc receptor binding dependent effector functions can be mediated by the interaction of the Fc-region of an antibody with Fc receptors (FcRs), which are specialized cell surface receptors on hematopoietic cells. Fc receptors belong to the immunoglobulin superfamily, and have been shown to mediate both the removal of antibody-coated pathogens by phagocytosis of immune complexes, and the lysis of erythrocytes and various other cellular targets (e.g. tumor cells) coated with the corresponding antibody, via antibody dependent cell mediated cytotoxicity (ADCC) (see e.g. Van de Winkel, J. G. and Anderson, C. L., J. Leukoc. Biol. 49 (1991) 511-524). FcRs are defined by their specificity for immunoglobulin isotypes: Fc receptors for IgG antibodies are referred to as FcγR. Fc receptor binding is described e.g. in Ravetch, J. V. and Kinet, J. P., Annu. Rev. Immunol. 9 (1991) 457-492; Capel, P. J., et al., Immunomethods 4

(1994) 25-34; de Haas, M., et al., J. Lab. Clin. Med. 126 (1995) 330-341; and Gessner, J. E., et al., Ann. Hematol. 76 (1998) 231-248.

Cross-linking of receptors for the Fc-region of IgG antibodies (FcγR) triggers a wide variety of effector functions including phagocytosis, antibody-dependent cellular cytotoxicity, and release of inflammatory mediators, as well as immune complex clearance and regulation of antibody production. In humans, three classes of FcγR have been characterized, which are:

FcγRI (CD64) binds monomeric IgG with high affinity and is expressed on macrophages, monocytes, neutrophils and eosinophils. Modification in the Fc-region IgG at least at one of the amino acid residues E233-G236, P238, D265, N297, A327 and P329 (numbering according to EU index of Kabat) reduce binding to FcγRI. IgG2 residues at positions 233-236, substituted into IgG1 and IgG4, reduced binding to FcγRI by $10^3$-fold and eliminated the human monocyte response to antibody-sensitized red blood cells (Armour, K. L., et al., Eur. J. Immunol. 29 (1999) 2613-2624).

FcγRII (CD32) binds complexed IgG with medium to low affinity and is widely expressed. This receptor can be divided into two sub-types, FcγRIIA and FcγRIIB FcγRIIA is found on many cells involved in killing (e.g. macrophages, monocytes, neutrophils) and seems able to activate the killing process. FcγRIIB seems to play a role in inhibitory processes and is found on B cells, macrophages and on mast cells and eosinophils. On B-cells it seems to function to suppress further immunoglobulin production and isotype switching to, for example, the IgE class. On macrophages, FcγRIIB acts to inhibit phagocytosis as mediated through FcγRIIA. On eosinophils and mast cells the B-form may help to suppress activation of these cells through IgE binding to its separate receptor. Reduced binding for FcγRIIA is found e.g. for antibodies comprising an IgG Fc-region with mutations at least at one of the amino acid residues E233-G236, P238, D265, N297, A327, P329, D270, Q295, A327, R292, and K414 (numbering according to EU index of Kabat).

FcγRIII (CD16) binds IgG with medium to low affinity and exists as two types. FcγRIIIA is found on NK cells, macrophages, eosinophils and some monocytes and T cells and mediates ADCC. Fc γ RIIIB is highly expressed on neutrophils. Reduced binding to FcγRIIIA is found e.g. for antibodies comprising an IgG Fc-region with mutation at least at one of the amino acid residues E233-G236, P238, D265, N297, A327, P329, D270, Q295, A327, S239, E269, E293, Y296, V303, A327, K338 and D376 (numbering according to EU index of Kabat).

Mapping of the binding sites on human IgG1 for Fc receptors, the above mentioned mutation sites and methods for measuring binding to FcγRI and FcγRIIA are described in Shields, R. L., et al. J. Biol. Chem. 276 (2001) 6591-6604.

The term "ADCC" or "antibody-dependent cellular cytotoxicity" is a function mediated by Fc receptor binding and refers to lysis of target cells by an antibody as reported herein in the presence of effector cells. The capacity of the antibody to induce the initial steps mediating ADCC is investigated by measuring their binding to Fcγ receptors expressing cells, such as cells, recombinantly expressing FcγRI and/or FcγRIIA or NK cells (expressing essentially FcγRIIIA) In particular, binding to FcγR on NK cells is measured.

An "activating Fc receptor" is an Fc receptor that following engagement by an Fc region of an antibody elicits signaling events that stimulate the receptor-bearing cell to perform effector functions. Activating Fc receptors include FcγRIIIa (CD16a), FcγRI (CD64), FcγRIIa (CD32), and FcαRI (CD89). A particular activating Fc receptor is human FcγRIIIa (see UniProt accession no. P08637, version 141).

The "Tumor Necrosis factor receptor superfamily" or "TNF receptor superfamily" currently consists of 27 receptors. It is a group of cytokine receptors characterized by the ability to bind tumor necrosis factors (TNFs) via an extracellular cysteine-rich domain (CRD). These pseudorepeats are defined by intrachain disulphides generated by highly conserved cysteine residues within the receptor chains. With the exception of nerve growth factor (NGF), all TNFs are homologous to the archetypal TNF-alpha. In their active form, the majority of TNF receptors form trimeric complexes in the plasma membrane. Accordingly, most TNF receptors contain transmembrane domains (TMDs). Several of these receptors also contain intracellular death domains (DDs) that recruit caspase-interacting proteins following ligand binding to initiate the extrinsic pathway of caspase activation. Other TNF superfamily receptors that lack death domains bind TNF receptor-associated factors and activate intracellular signaling pathways that can lead to proliferation or differentiation. These receptors can also initiate apoptosis, but they do so via indirect mechanisms. In addition to regulating apoptosis, several TNF superfamily receptors are involved in regulating immune cell functions such as B cell homeostasis and activation, natural killer cell activation, and T cell co-stimulation. Several others regulate cell type-specific responses such as hair follicle development and osteoclast development. Members of the TNF receptor superfamily include the following: Tumor necrosis factor receptor 1 (1A) (TNFRSF1A, CD120a), Tumor necrosis factor receptor 2 (1B) (TNFRSF1B, CD120b), Lymphotoxin beta receptor (LTBR, CD18), OX40 (TNFRSF4, CD134), CD40 (Bp50), Fas receptor (Apo-1, CD95, FAS), Decoy receptor 3 (TR6, M68, TNFRSF6B), CD27 (S152, Tp55), CD30 (Ki-1, TNFRSF8), 4-1BB (CD137, TNFRSF9), DR4 (TRAILR1, Apo-2, CD261, TNFRSF10A), DR5 (TRAILR2, CD262, TNFRSF10B), Decoy Receptor 1 (TRAILR3, CD263, TNFRSF10C), Decoy Receptor 2 (TRAILR4, CD264, TNFRSF10D), RANK (CD265, TNFRSF11A), Osteoprotegerin (OCIF, TR1, TNFRSF11B), TWEAK receptor (Fn14, CD266, TNFRSF12A), TACI (CD267, TNFRSF13B), BAFF receptor (CD268, TNFRSF13C), Herpesvirus entry mediator (HVEM, TR2, CD270, TNFRSF14), Nerve growth factor receptor (p75NTR, CD271, NGFR), B-cell maturation antigen (CD269, TNFRSF17), Glucocorticoid-induced TNFR-related (GITR, ATTR, CD357, TNFRSF18), TROY (TNFRSF19), DR6 (CD358, TNFRSF21), DR3 (Apo-3, TRAMP, WS-1, TNFRSF25) and Ectodysplasin A2 receptor (XEDAR, EDA2R).

Several members of the tumor necrosis factor receptor (TNFR) family function after initial T cell activation to sustain T cell responses. The term "costimulatory TNF receptor family member" or "costimulatory TNF family receptor" refers to a subgroup of TNF receptor family members, which are able to costimulate proliferation and cytokine production of T-cells. The term refers to any native TNF family receptor from any vertebrate source, including mammals such as primates (e.g. humans), non-human primates (e.g. cynomolgus monkeys) and rodents (e.g. mice and rats), unless otherwise indicated. In specific embodiments of the invention, costimulatory TNF receptor family members are selected from the group consisting of OX40 (CD134), 4-1BB (CD137), CD27, HVEM (CD270), CD30, and GITR, all of which can have costimulatory effects on T cells. More particularly, the costimulatory TNF receptor family member is 4-1BB.

The term "4-1BB", as used herein, refers to any native 4-1BB from any vertebrate source, including mammals such as primates (e.g. humans) and rodents (e.g., mice and rats), unless otherwise indicated. The term encompasses "full-length," unprocessed 4-1BB as well as any form of 4-1BB that results from processing in the cell. The term also encompasses naturally occurring variants of 4-1BB, e.g., splice variants or allelic variants. The amino acid sequence of an exemplary human 4-1BB is shown in SEQ ID NO:106 (Uniprot accession no. Q07011), the amino acid sequence of an exemplary murine 4-1BB is shown in SEQ ID NO: 107 (Uniprot accession no. P20334) and the amino acid sequence of an exemplary cynomolgous 4-1BB (from *Macaca mulatta*) is shown in SEQ ID NO:108 (Uniprot accession no. F6W5G6).

The terms "anti-4-1BB antibody", "anti-4-1BB", "4-1BB antibody and "an antibody that specifically binds to 4-1BB" refer to an antibody that is capable of binding 4-1BB with sufficient affinity such that the antibody is useful as a diagnostic and/or therapeutic agent in targeting 4-1BB. In one embodiment, the extent of binding of an anti-4-1BB antibody to an unrelated, non-4-1BB protein is less than about 10% of the binding of the antibody to 4-1BB as measured, e.g., by a radioimmunoassay (RIA) or flow cytometry (FACS). In certain embodiments, an antibody that binds to 4-1BB has a dissociation constant ($K_D$) of ≤1 µM, ≤100 nM, ≤10 nM, ≤1 nM, ≤0.1 nM, ≤0.01 nM, or ≤0.001 nM (e.g. $10^{-6}$ M or less, e.g. from $10^{-68}$M to $10^{-13}$M, e.g., from $10^{-8}$M to $10^{-10}$ M). In particular, the anti-4-1BB antibody is clone 20H4.9 as disclosed in U.S. Pat. No. 7,288,638.

The term "peptide linker" refers to a peptide comprising one or more amino acids, typically about 2 to 20 amino acids. Peptide linkers are known in the art or are described herein. Suitable, non-immunogenic linker peptides are, for example, $(G_4S)_n$, $(SG_4)_n$ or $G_4(SG_4)_n$ peptide linkers, wherein "n" is generally a number between 1 and 10, typically between 2 and 4, in particular 2, i.e. the peptides selected from the group consisting of GGGGS (SEQ ID NO: 109) GGGGSGGGGS (SEQ ID NO:110), SGGGGSGGGG (SEQ ID NO:111) and GGGGSGGGGSGGGG (SEQ ID NO:112), but also include the sequences GSPGSSSSGS (SEQ ID NO:113), $(G_4S)_3$ (SEQ ID NO:114), $(G_4S)_4$ (SEQ ID NO:115), GSGSGSGS (SEQ ID NO:116), GSGSGNGS (SEQ ID NO:117), GGSGSGSG (SEQ ID NO:118), GGSGSG (SEQ ID NO:119), GGSG (SEQ ID NO:120), GGSGNGSG (SEQ ID NO:121), GGNGSGSG (SEQ ID NO:122) and GGNGSG (SEQ ID NO:123). Peptide linkers of particular interest are $(G_4S)$ (SEQ ID NO:109), $(G_4S)_2$ or GGGGSGGGGS (SEQ ID NO:110), $(G_4S)_3$ (SEQ ID NO:114) and $(G_4S)_4$ (SEQ ID NO:115).

The term "amino acid" as used within this application denotes the group of naturally occurring carboxy α-amino acids comprising alanine (three letter code: ala, one letter code: A), arginine (arg, R), asparagine (asn, N), aspartic acid (asp, D), cysteine (cys, C), glutamine (gln, Q), glutamic acid (glu, E), glycine (gly, G), histidine (his, H), isoleucine (ile, I), leucine (leu, L), lysine (lys, K), methionine (met, M), phenylalanine (phe, F), proline (pro, P), serine (ser, S), threonine (thr, T), tryptophan (trp, W), tyrosine (tyr, Y), and valine (val, V).

By "fused" or "connected" is meant that the components (e.g. a heavy chain of an antibody and a Fab fragment) are linked by peptide bonds, either directly or via one or more peptide linkers.

"Percent (%) amino acid sequence identity" with respect to a reference polypeptide (protein) sequence is defined as the percentage of amino acid residues in a candidate sequence that are identical with the amino acid residues in the reference polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN. SAWI or Megalign (DNASTAR) software. Those skilled in the art can determine appropriate parameters for aligning sequences, including any algorithms needed to achieve maximal alignment over the full length of the sequences being compared. For purposes herein, however, % amino acid sequence identity values are generated using the sequence comparison computer program ALIGN-2. The ALIGN-2 sequence comparison computer program was authored by Genentech, Inc., and the source code has been filed with user documentation in the U.S. Copyright Office, Washington D.C., 20559, where it is registered under U.S. Copyright Registration No. TXU510087. The ALIGN-2 program is publicly available from Genentech, Inc., South San Francisco, Calif., or may be compiled from the source code. The ALIGN-2 program should be compiled for use on a UNIX operating system, including digital UNIX V4.0D. All sequence comparison parameters are set by the ALIGN-2 program and do not vary. In situations where ALIGN-2 is employed for amino acid sequence comparisons, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) is calculated as follows:

$$100 \text{ times the fraction } X/Y$$

where X is the number of amino acid residues scored as identical matches by the sequence alignment program ALIGN-2 in that program's alignment of A and B, and where Y is the total number of amino acid residues in B. It will be appreciated that where the length of amino acid sequence A is not equal to the length of amino acid sequence B, the % amino acid sequence identity of A to B will not equal the % amino acid sequence identity of B to A. Unless specifically stated otherwise, all % amino acid sequence identity values used herein are obtained as described in the immediately preceding paragraph using the ALIGN-2 computer program.

In certain embodiments, amino acid sequence variants of the TNF ligand trimer-containing antigen binding molecules provided herein are contemplated. For example, it may be desirable to improve the binding affinity and/or other biological properties of the TNF ligand trimer-containing antigen binding molecules. Amino acid sequence variants of the TNF ligand trimer-containing antigen binding molecules may be prepared by introducing appropriate modifications into the nucleotide sequence encoding the molecules, or by peptide synthesis. Such modifications include, for example, deletions from, and/or insertions into and/or substitutions of residues within the amino acid sequences of the antibody.

Any combination of deletion, insertion, and substitution can be made to arrive at the final construct, provided that the final construct possesses the desired characteristics, e.g., antigen-binding. Sites of interest for substitutional mutagenesis include the HVRs and Framework (FRs). Conservative substitutions are provided in Table B under the heading "Preferred Substitutions" and further described below in reference to amino acid side chain classes (1) to (6). Amino acid substitutions may be introduced into the molecule of interest and the products screened for a desired activity, e.g., retained/improved antigen binding, decreased immunogenicity, or improved ADCC or CDC.

TABLE B

| Original Residue | Exemplary Substitutions | Preferred Substitutions |
|---|---|---|
| Ala (A) | Val; Leu; Ile | Val |
| Arg (R) | Lys; Gln; Asn | Lys |
| Asn (N) | Gln; His; Asp, Lys; Arg | Gln |
| Asp (D) | Glu; Asn | Glu |
| Cys (C) | Ser; Ala | Ser |
| Gln (Q) | Asn; Glu | Asn |
| Glu (E) | Asp; Gln | Asp |
| Gly (G) | Ala | Ala |
| His (H) | Asn; Gln; Lys; Arg | Arg |
| Ile (I) | Leu; Val; Met; Ala; Phe; Norleucine | Leu |
| Leu (L) | Norleucine; Ile; Val; Met; Ala; Phe | Ile |
| Lys (K) | Arg; Gln; Asn | Arg |
| Met (M) | Leu; Phe; Ile | Leu |
| Phe (F) | Trp; Leu; Val; Ile; Ala; Tyr | Tyr |
| Pro (P) | Ala | Ala |
| Ser (S) | Thr | Thr |
| Thr (T) | Val; Ser | Ser |
| Trp (W) | Tyr; Phe | Tyr |
| Tyr (Y) | Trp; Phe; Thr; Ser | Phe |
| Val (V) | Ile; Leu; Met; Phe; Ala; Norleucine | Leu |

Amino acids may be grouped according to common side-chain properties:
(1) hydrophobic: Norleucine, Met, Ala, Val, Leu, Ile;
(2) neutral hydrophilic: Cys, Ser, Thr, Asn, Gln;
(3) acidic: Asp, Glu;
(4) basic: His, Lys, Arg;
(5) residues that influence chain orientation: Gly, Pro;
(6) aromatic: Trp, Tyr, Phe.

Non-conservative substitutions will entail exchanging a member of one of these classes for another class.

The term "amino acid sequence variants" includes substantial variants wherein there are amino acid substitutions in one or more hypervariable region residues of a parent antigen binding molecule (e.g. a humanized or human antibody). Generally, the resulting variant(s) selected for further study will have modifications (e.g., improvements) in certain biological properties (e.g., increased affinity, reduced immunogenicity) relative to the parent antigen binding molecule and/or will have substantially retained certain biological properties of the parent antigen binding molecule. An exemplary substitutional variant is an affinity matured antibody, which may be conveniently generated, e.g., using phage display-based affinity maturation techniques such as those described herein. Briefly, one or more HVR residues are mutated and the variant antigen binding molecules displayed on phage and screened for a particular biological activity (e.g. binding affinity). In certain embodiments, substitutions, insertions, or deletions may occur within one or more HVRs so long as such alterations do not substantially reduce the ability of the antigen binding molecule to bind antigen. For example, conservative alterations (e.g., conservative substitutions as provided herein) that do not substantially reduce binding affinity may be made in HVRs. A useful method for identification of residues or regions of an antibody that may be targeted for mutagenesis is called "alanine scanning mutagenesis" as described by Cunningham and Wells (1989) Science, 244:1081-1085. In this method, a residue or group of target residues (e.g., charged residues such as Arg, Asp, His, Lys, and Glu) are identified and replaced by a neutral or negatively charged amino acid (e.g., alanine or polyalanine) to determine whether the interaction of the antibody with antigen is affected. Further substitutions may be introduced at the amino acid locations demonstrating functional sensitivity to the initial substitutions. Alternatively, or additionally, a crystal structure of an antigen-antigen binding molecule complex to identify contact points between the antibody and antigen. Such contact residues and neighboring residues may be targeted or eliminated as candidates for substitution. Variants may be screened to determine whether they contain the desired properties.

Amino acid sequence insertions include amino- and/or carboxyl-terminal fusions ranging in length from one residue to polypeptides containing a hundred or more residues, as well as intrasequence insertions of single or multiple amino acid residues. Examples of terminal insertions include bispecific antigen binding molecules of the invention with an N-terminal methionyl residue. Other insertional variants of the molecule include the fusion to the N- or C-terminus to a polypeptide which increases the serum half-life of the bispecific antigen binding molecules.

In certain embodiments, the bispecific antigen binding molecules provided herein are altered to increase or decrease the extent to which the antibody is glycosylated. Glycosylation variants of the molecules may be conveniently obtained by altering the amino acid sequence such that one or more glycosylation sites is created or removed. Where the TNF ligand trimer-containing antigen binding molecule comprises an Fc region, the carbohydrate attached thereto may be altered. Native antibodies produced by mammalian cells typically comprise a branched, biantennary oligosaccharide that is generally attached by an N-linkage to Asn297 of the CH2 domain of the Fc region. See, e.g., Wright et al. TIBTECH 15:26-32 (1997). The oligosaccharide may include various carbohydrates, e.g., mannose, N-acetyl glucosamine (GlcNAc), galactose, and sialic acid, as well as a fucose attached to a GlcNAc in the "stem" of the biantennary oligosaccharide structure. In some embodiments, modifications of the oligosaccharide in TNF family ligand trimer-containing antigen binding molecule may be made in order to create variants with certain improved properties. In one aspect, variants of bispecific antigen binding molecules or antibodies of the invention are provided having a carbohydrate structure that lacks fucose attached (directly or indirectly) to an Fc region. Such fucosylation variants may have improved ADCC function, see e.g. US Patent Publication Nos. US 2003/0157108 (Presta, L.) or US 2004/0093621 (Kyowa Hakko Kogyo Co., Ltd). In another aspect, variants of the bispecific antigen binding molecules or antibodies of the invention are provided with bisected oligosaccharides, e.g., in which a biantennary oligosaccharide attached to the Fc region is bisected by GlcNAc. Such variants may have reduced fucosylation and/or improved ADCC function., see for example WO 2003/011878 (Jean-Mairet et al.); U.S. Pat. No. 6,602,684 (Umana et al.); and US 2005/0123546 (Umana et al.). Variants with at least one galactose residue in the oligosaccharide attached to the Fc region are also provided. Such antibody variants may have improved CDC function and are described, e.g., in WO 1997/30087 (Patel et al.); WO 1998/58964 (Raju, S.); and WO 1999/22764 (Raju, S.).

In certain aspects, it may be desirable to create cysteine engineered variants of the bispecific antigen binding molecules of the invention, e.g., "thioMAbs," in which one or more residues of the molecule are substituted with cysteine residues. In particular aspects, the substituted residues occur at accessible sites of the molecule. By substituting those residues with cysteine, reactive thiol groups are thereby positioned at accessible sites of the antibody and may be used to conjugate the antibody to other moieties, such as drug moieties or linker-drug moieties, to create an immunoconjugate. In certain aspects, any one or more of the following residues may be substituted with cysteine: V205 (Kabat numbering) of the light chain; A118 (EU numbering) of the heavy chain; and S400 (EU numbering) of the heavy chain Fc region. Cysteine engineered antigen binding molecules may be generated as described, e.g., in U.S. Pat. No. 7,521,541.

The term "polynucleotide" refers to an isolated nucleic acid molecule or construct, e.g. messenger RNA (mRNA), virally-derived RNA, or plasmid DNA (pDNA). A polynucleotide may comprise a conventional phosphodiester bond or a non-conventional bond (e.g. an amide bond, such as found in peptide nucleic acids (PNA). The term "nucleic acid molecule" refers to any one or more nucleic acid segments, e.g. DNA or RNA fragments, present in a polynucleotide.

By "isolated" nucleic acid molecule or polynucleotide is intended a nucleic acid molecule, DNA or RNA, which has been removed from its native environment. For example, a recombinant polynucleotide encoding a polypeptide contained in a vector is considered isolated for the purposes of the present invention. Further examples of an isolated polynucleotide include recombinant polynucleotides maintained in heterologous host cells or purified (partially or substantially) polynucleotides in solution. An isolated polynucleotide includes a polynucleotide molecule contained in cells that ordinarily contain the polynucleotide molecule, but the polynucleotide molecule is present extrachromosomally or at a chromosomal location that is different from its natural chromosomal location. Isolated RNA molecules include in vivo or in vitro RNA transcripts of the present invention, as well as positive and negative strand forms, and double-stranded forms. Isolated polynucleotides or nucleic acids according to the present invention further include such molecules produced synthetically. In addition, a polynucleotide or a nucleic acid may be or may include a regulatory element such as a promoter, ribosome binding site, or a transcription terminator.

By a nucleic acid or polynucleotide having a nucleotide sequence at least, for example, 95% "identical" to a reference nucleotide sequence of the present invention, it is intended that the nucleotide sequence of the polynucleotide is identical to the reference sequence except that the polynucleotide sequence may include up to five point mutations per each 100 nucleotides of the reference nucleotide sequence. In other words, to obtain a polynucleotide having a nucleotide sequence at least 95% identical to a reference nucleotide sequence, up to 5% of the nucleotides in the reference sequence may be deleted or substituted with another nucleotide, or a number of nucleotides up to 5% of the total nucleotides in the reference sequence may be inserted into the reference sequence. These alterations of the reference sequence may occur at the 5' or 3' terminal positions of the reference nucleotide sequence or anywhere between those terminal positions, interspersed either individually among residues in the reference sequence or in one or more contiguous groups within the reference sequence. As a practical matter, whether any particular polynucleotide sequence is at least 80%, 85%, 90%, 95%, 96%, 97%, 98% or 99% identical to a nucleotide sequence of the present invention can be determined conventionally using known computer programs, such as the ones discussed above for polypeptides (e.g. ALIGN-2).

The term "expression cassette" refers to a polynucleotide generated recombinantly or synthetically, with a series of specified nucleic acid elements that permit transcription of a particular nucleic acid in a target cell. The recombinant expression cassette can be incorporated into a plasmid, chromosome, mitochondrial DNA, plastid DNA, virus, or nucleic acid fragment. Typically, the recombinant expression cassette portion of an expression vector includes, among other sequences, a nucleic acid sequence to be transcribed and a promoter. In certain embodiments, the expression cassette of the invention comprises polynucleotide sequences that encode bispecific antigen binding molecules of the invention or fragments thereof.

The term "vector" or "expression vector" is synonymous with "expression construct" and refers to a DNA molecule that is used to introduce and direct the expression of a specific gene to which it is operably associated in a target cell. The term includes the vector as a self-replicating nucleic acid structure as well as the vector incorporated into the genome of a host cell into which it has been introduced. The expression vector of the present invention comprises an expression cassette. Expression vectors allow transcription of large amounts of stable mRNA. Once the expression vector is inside the target cell, the ribonucleic acid molecule or protein that is encoded by the gene is produced by the cellular transcription and/or translation machinery. In one embodiment, the expression vector of the invention comprises an expression cassette that comprises polynucleotide sequences that encode bispecific antigen binding molecules of the invention or fragments thereof.

The terms "host cell", "host cell line," and "host cell culture" are used interchangeably and refer to cells into which exogenous nucleic acid has been introduced, including the progeny of such cells. Host cells include "transformants" and "transformed cells," which include the primary transformed cell and progeny derived therefrom without regard to the number of passages. Progeny may not be completely identical in nucleic acid content to a parent cell, but may contain mutations. Mutant progeny that have the same function or biological activity as screened or selected for in the originally transformed cell are included herein. A host cell is any type of cellular system that can be used to generate the bispecific antigen binding molecules of the present invention. Host cells include cultured cells, e.g. mammalian cultured cells, such as CHO cells, BHK cells, NS0 cells, SP2/0 cells, YO myeloma cells, P3X63 mouse myeloma cells, PER cells, PER.C6 cells or hybridoma cells, yeast cells, insect cells, and plant cells, to name only a few, but also cells comprised within a transgenic animal, transgenic plant or cultured plant or animal tissue.

An "effective amount" of an agent refers to the amount that is necessary to result in a physiological change in the cell or tissue to which it is administered.

A "therapeutically effective amount" of an agent, e.g. a pharmaceutical composition, refers to an amount effective, at dosages and for periods of time necessary, to achieve the desired therapeutic or prophylactic result. A therapeutically effective amount of an agent for example eliminates, decreases, delays, minimizes or prevents adverse effects of a disease.

An "individual" or "subject" is a mammal. Mammals include, but are not limited to, domesticated animals (e.g. cows, sheep, cats, dogs, and horses), primates (e.g. humans and non-human primates such as monkeys), rabbits, and rodents (e.g. mice and rats). Particularly, the individual or subject is a human.

The term "pharmaceutical composition" refers to a preparation which is in such form as to permit the biological activity of an active ingredient contained therein to be effective, and which contains no additional components which are unacceptably toxic to a subject to which the formulation would be administered.

A "pharmaceutically acceptable excipient" refers to an ingredient in a pharmaceutical composition, other than an active ingredient, which is nontoxic to a subject. A pharmaceutically acceptable excipient includes, but is not limited to, a buffer, a stabilizer, or a preservative.

The term "package insert" is used to refer to instructions customarily included in commercial packages of therapeutic products, that contain information about the indications, usage, dosage, administration, combination therapy, contraindications and/or warnings concerning the use of such therapeutic products.

As used herein, "treatment" (and grammatical variations thereof such as "treat" or "treating") refers to clinical intervention in an attempt to alter the natural course of the individual being treated, and can be performed either for prophylaxis or during the course of clinical pathology. Desirable effects of treatment include, but are not limited to, preventing occurrence or recurrence of disease, alleviation of symptoms, diminishment of any direct or indirect pathological consequences of the disease, preventing metastasis, decreasing the rate of disease progression, amelioration or palliation of the disease state, and remission or improved prognosis.

In some embodiments, the molecules of the invention are used to delay development of a disease or to slow the progression of a disease.

The term "cancer" as used herein refers to proliferative diseases, such as lymphomas, lymphocytic leukemias, lung cancer, non-small cell lung (NSCL) cancer, bronchioloalviolar cell lung cancer, bone cancer, pancreatic cancer, skin cancer, cancer of the head or neck, cutaneous or intraocular melanoma, uterine cancer, ovarian cancer, rectal cancer, cancer of the anal region, stomach cancer, gastric cancer, colon cancer, breast cancer, uterine cancer, carcinoma of the fallopian tubes, carcinoma of the endometrium, carcinoma of the cervix, carcinoma of the vagina, carcinoma of the vulva, Hodgkin's Disease, cancer of the esophagus, cancer of the small intestine, cancer of the endocrine system, cancer of the thyroid gland, cancer of the parathyroid gland, cancer of the adrenal gland, sarcoma of soft tissue, cancer of the urethra, cancer of the penis, prostate cancer, cancer of the bladder, cancer of the kidney or ureter, renal cell carcinoma, carcinoma of the renal pelvis, mesothelioma, hepatocellular cancer, biliary cancer, neoplasms of the central nervous system (CNS), spinal axis tumors, brain stem glioma, glioblastoma multiforme, astrocytomas, schwanomas, ependymonas, medulloblastomas, meningiomas, squamous cell carcinomas, pituitary adenoma and Ewings sarcoma, including refractory versions of any of the above cancers, or a combination of one or more of the above cancers.

Bispecific Antibodies of the Invention

The invention provides novel biospecific antigen binding molecules with particularly advantageous properties such as producibility, stability, binding affinity, biological activity, targeting efficiency and reduced toxicity.

Exemplary Bispecific Antigen Binding Molecules

In one aspect, the invention provides bispecific antigen binding molecules, comprising (a) at least one antigen binding domain capable of specific binding to 4-1BB, (b) at least one antigen binding domain capable of specific binding to a target cell antigen, and (c) a Fc domain composed of a first and a second subunit capable of stable association, wherein the antigen binding domain capable of specific binding to 4-1BB comprises a heavy chain variable region ($V_H$4-1BB) comprising (i) CDR-H1 comprising the amino acid sequence of SEQ ID NO:1, (ii) CDR-H2 comprising the amino acid sequence of SEQ ID NO:2, and (iii) CDR-H3 comprising the amino acid sequence of SEQ ID NO:3, and a light chain variable region ($V_L$4-1BB) comprising (iv) CDR-L1 comprising the amino acid sequence of SEQ ID NO:4, (v) CDR-L2 comprising the amino acid sequence of SEQ ID NO:5, and (vi) CDR-L3 comprising the amino acid sequence of SEQ ID NO:6.

In a particular aspect, these bispecific antigen binding molecules are characterized by targeted agonistic binding to 4-1BB. In particular, the bispecific antigen binding molecule is a 4-1BB agonist that is targeted against a tumor associated target cell antigen.

In one aspect, provided is a bispecific antigen binding molecule, comprising at least one antigen binding domain capable of specific binding to 4-1BB, wherein said antigen binding domain comprises a heavy chain variable region ($V_H$4-1BB) comprising an amino acid sequence that is at least about 95%, 96%, 97%, 98%, 99% or 100% identical to the amino acid sequence of SEQ ID NO:7 and a light chain variable region ($V_L$4-1BB) comprising an amino acid sequence that is at least about 95%, 96%, 97%, 98%, 99% or 100% identical to the amino acid sequence of SEQ ID NO:8. In a particular aspect, the antigen binding domain capable of specific binding to 4-1BB comprises a heavy chain variable region ($V_H$4-1BB) comprising the amino acid sequence of SEQ ID NO:7 and a light chain variable region ($V_L$4-1BB) comprising the amino acid sequence of SEQ ID NO:8.

In one aspect, provided is a bispecific antigen binding molecule comprising at least one antigen binding domain capable of specific binding to 4-1BB, wherein the antigen binding domain capable of specific binding to 4-1BB is a Fab fragment.

In another aspect, the bispecific antigen binding molecule of the invention comprises at least two antigen binding domains capable of specific binding to 4-1BB as defined herein before. In particular, the bispecific antigen binding molecule of the invention comprises two antigen binding domains capable of specific binding to 4-1BB as defined herein before. In another particular aspect, the bispecific antigen binding molecule of the invention comprises four antigen binding domains capable of specific binding to 4-1BB as defined herein before.

The bispecific antigen binding molecules of the invention are further characterized by comprising at least one antigen binding domain capable of specific binding to a target cell antigen. The bispecific antigen binding molecules thus possess the advantage over conventional antibodies capable of specific binding to 4-1BB, that they selectively induce a costimulatory T cell response at the target cells, which are typically cancer cells. In one aspect, the target cell antigen is selected from the group consisting of Fibroblast Activation Protein (FAP), Melanoma-associated Chondroitin Sulfate Proteoglycan (MCSP), Epidermal Growth Factor Receptor (EGFR), Carcinoembryonic Antigen (CEA), CD19, CD20 and CD33. Particularly, the target cell antigen is selected from Fibroblast Activation Protein (FAP), Carcinoembryonic Antigen (CEA) and CD19. In one particular aspect, the target cell antigen is selected from Fibroblast Activation Protein (FAP) and Carcinoembryonic Antigen (CEA). In another particular aspect, the target cell antigen is CD19.

Bispecific Antigen Binding Molecules Wherein the Target Cell Antigen is FAP

In a particular aspect, the target cell antigen is Fibroblast Activation Protein (FAP). FAP binding moieties have been described in WO 2012/02006 which is included by reference in its entirety. FAP binding moieties of particular interest are described below.

In one aspect, the invention provides a bispecific antigen binding molecule, wherein the antigen binding domain capable of specific binding to Fibroblast Activation Protein (FAP) comprises
(a) a heavy chain variable region ($V_H$FAP) comprising (i) CDR-H1 comprising the amino acid sequence of SEQ ID NO:9, (ii) CDR-H2 comprising the amino acid sequence of SEQ ID NO:10, and (iii) CDR-H3 comprising the amino acid sequence of SEQ ID NO:11, and a light chain variable region ($V_L$FAP) comprising (iv) CDR-L1 comprising the amino acid sequence of SEQ ID NO:12, (v) CDR-L2 comprising the amino acid sequence of SEQ ID NO:13, and (vi) CDR-L3 comprising the amino acid sequence of SEQ ID NO:14, or
(b) a heavy chain variable region ($V_H$FAP) comprising (i) CDR-H1 comprising the amino acid sequence of SEQ ID NO:15, (ii) CDR-H2 comprising the amino acid sequence of SEQ ID NO:16, and (iii) CDR-H3 comprising the amino acid sequence of SEQ ID NO:17, and a a light chain variable region ($V_L$FAP) comprising (iv) CDR-L1 comprising the amino acid sequence of SEQ ID NO:18, (v) CDR-L2 comprising the amino acid sequence of SEQ ID NO:19, and (vi) CDR-L3 comprising the amino acid sequence of SEQ ID NO:20.

In particular, provided is a a bispecific antigen binding molecule, wherein the antigen binding domain capable of specific binding to FAP comprises a heavy chain variable region ($V_H$FAP) comprising (i) CDR-H1 comprising the amino acid sequence of SEQ ID NO:15, (ii) CDR-H2 comprising the amino acid sequence of SEQ ID NO:16, and (iii) CDR-H3 comprising the amino acid sequence of SEQ ID NO:17, and a a light chain variable region ($V_L$FAP) comprising (iv) CDR-L1 comprising the amino acid sequence of SEQ ID NO:18, (v) CDR-L2 comprising the amino acid sequence of SEQ ID NO:19, and (vi) CDR-L3 comprising the amino acid sequence of SEQ ID NO:20.

In another aspect, the antigen binding domain capable of specific binding to FAP comprises a heavy chain variable region ($V_H$FAP) comprising (i) CDR-H1 comprising the amino acid sequence of SEQ ID NO:9, (ii) CDR-H2 comprising the amino acid sequence of SEQ ID NO:10, and (iii) CDR-H3 comprising the amino acid sequence of SEQ ID NO:11, and a light chain variable region ($V_L$FAP) comprising (iv) CDR-L1 comprising the amino acid sequence of SEQ ID NO:12, (v) CDR-L2 comprising the amino acid sequence of SEQ ID NO:13, and (vi) CDR-L3 comprising the amino acid sequence of SEQ ID NO:14.

Particularly, provided is a bispecific antigen binding molecule, wherein the antigen binding domain capable of specific binding to Fibroblast Activation Protein (FAP) comprises
(a) a heavy chain variable region ($V_H$FAP) comprising an amino acid sequence that is at least about 95%, 96%, 97%, 98%, 99% or 100% identical to the amino acid sequence of SEQ ID NO:21, and a light chain variable region ($V_L$FAP) comprising an amino acid sequence that is at least about 95%, 96%, 97%, 98%, 99% or 100% identical to the amino acid sequence of SEQ ID NO:22, or
(b) a heavy chain variable region ($V_H$FAP) comprising an amino acid sequence that is at least about 95%, 96%, 97%, 98%, 99% or 100% identical to the amino acid sequence of SEQ ID NO:23, and a light chain variable region ($V_L$FAP) comprising an amino acid sequence that is at least about 95%, 96%, 97%, 98%, 99% or 100% identical to the amino acid sequence of SEQ ID NO:24.

In one aspect, the antigen binding domain capable of specific binding to FAP comprises a heavy chain variable region VH comprising the amino acid sequence of SEQ ID NO: 21 and a light chain variable region comprising an amino acid sequence of SEQ ID NO: 22 or the antigen binding domain capable of specific binding to FAP comprises a heavy chain variable region VH comprising an amino acid sequence of SEQ ID NO:23 and a light chain variable region comprising an amino acid sequence of SEQ ID NO:24.

Bispecific Antigen Binding Molecules Binding to 4-1BB and FAP

In another aspect, provided is a bispecific antigen binding molecule, wherein
(i) the antigen binding domain capable of specific binding to 4-1BB comprises a heavy chain variable region VH comprising the amino acid sequence of SEQ ID NO: 7 and a light chain variable region comprising an amino acid sequence of SEQ ID NO: 8 and
(ii) the antigen binding domain capable of specific binding to FAP comprises a heavy chain variable region VH comprising an amino acid sequence of SEQ ID NO:23 and a light chain variable region comprising an amino acid sequence of SEQ ID NO:24.

In a further aspect, provided is a bispecific antigen binding molecule, wherein
(i) the antigen binding domain capable of specific binding to 4-1BB comprises a heavy chain variable region VH comprising the amino acid sequence of SEQ ID NO: 7 and a light chain variable region comprising an amino acid sequence of SEQ ID NO: 8 and
(ii) the antigen binding domain capable of specific binding to FAP comprises a heavy chain variable region VH comprising an amino acid sequence of SEQ ID NO:21 and a light chain variable region comprising an amino acid sequence of SEQ ID NO:22.

Bispecific Antigen Binding Molecules Binding to Mouse 4-1BB

In another aspect, provided is a bispecific antigen binding molecule, comprising at least one antigen binding domain capable of specific binding to mouse 4-1BB, at least one antigen binding domain capable of specific binding to a target cell antigen and a Fc domain composed of a first and a second subunit capable of stable association, wherein the antigen binding domain capable of specific binding to 4-1BB comprises a heavy chain variable region ($V_H$4-1BB) comprising (i) CDR-H1 comprising the amino acid sequence of SEQ ID NO:171, (ii) CDR-H2 comprising the amino acid sequence of SEQ ID NO:172, and (iii) CDR-H3 comprising the amino acid sequence of SEQ ID NO:173, and a light chain variable region ($V_L$4-1BB) comprising (iv) CDR-L1 comprising the amino acid sequence of SEQ ID NO:174, (v) CDR-L2 comprising the amino acid sequence of SEQ ID NO:175, and (vi) CDR-L3 comprising the amino acid sequence of SEQ ID NO:176.

In another aspect, provided is a bispecific antigen binding molecule, comprising at least one antigen binding domain capable of specific binding to mouse 4-1BB, at least one antigen binding domain capable of specific binding to a target cell antigen and a Fc domain composed of a first and a second subunit capable of stable association, wherein the antigen binding domain capable of specific binding to 4-1BB comprises a heavy chain variable region ($V_H$4-1BB) comprising (i) CDR-H1 comprising the amino acid sequence of SEQ ID NO:171, (ii) CDR-H2 comprising the amino acid sequence of SEQ ID NO:172, and (iii) CDR-H3 comprising the amino acid sequence of SEQ ID NO:173, and a light chain variable region ($V_L$4-1BB) comprising (iv) CDR-L1 comprising the amino acid sequence of SEQ ID NO:174, (v) CDR-L2 comprising the amino acid sequence of SEQ ID NO:175, and (vi) CDR-L3 comprising the amino acid sequence of SEQ ID NO:176, and wherein the antigen binding domain capable of specific binding to a target cell antigen binds to Fibroblast Activation Protein (FAP) and comprises
(a) a heavy chain variable region ($V_L$FAP) comprising (i) CDR-H1 comprising the amino acid sequence of SEQ ID NO:9, (ii) CDR-H2 comprising the amino acid sequence of SEQ ID NO:10, and (iii) CDR-H3 comprising the amino acid sequence of SEQ ID NO:11, and a light chain variable region ($V_L$FAP) comprising (iv) CDR-L1 comprising the amino acid sequence of SEQ ID NO:12, (v) CDR-L2 comprising the amino acid sequence of SEQ ID NO:13, and (vi) CDR-L3 comprising the amino acid sequence of SEQ ID NO:14.

In one aspect, provided is a bispecific antigen binding molecule, wherein
(i) the antigen binding domain capable of specific binding to mouse 4-1BB comprises a heavy chain variable region VH comprising the amino acid sequence of SEQ ID NO: 177 and a light chain variable region comprising an amino acid sequence of SEQ ID NO: 178 and
(ii) the antigen binding domain capable of specific binding to FAP comprises a heavy chain variable region VH comprising an amino acid sequence of SEQ ID NO:21 and a light chain variable region comprising an amino acid sequence of SEQ ID NO:22.

In a particular aspect, provided is a bispecific antigen binding molecule, comprising at least one antigen binding domain capable of specific binding to mouse 4-1BB, wherein the first subunit of the Fc domain comprises the amino acid substitutions K392D and K409D (numbering according to Kabat EU index) and the second subunit of the Fc region comprises the amino acid substitutions E356K and D399K, (numbering according to Kabat EU index).

Bispecific Antigen Binding Molecules Wherein the Target Cell Antigen is CEA

In a particular aspect, the target cell antigen is Carcinoembryonic Antigen (CEA). CEA binding moieties have been described for example in WO 2016/075278 A2 or WO 2007/071426 which are included by reference in its entirety. CEA binding moieties of particular interest are described below.

In one aspect, the invention provides a bispecific antigen binding molecule, wherein the antigen binding domain capable of specific binding to Carcinoembryonic Antigen (CEA) comprises
(a) a heavy chain variable region ($V_H$CEA) comprising (i) CDR-H1 comprising the amino acid sequence of SEQ ID NO:25, (ii) CDR-H2 comprising the amino acid sequence of SEQ ID NO:26, and (iii) CDR-H3 comprising the amino acid sequence of SEQ ID NO:27, and a light chain variable region ($V_L$CEA) comprising (iv) CDR-L1 comprising the amino acid sequence of SEQ ID NO:28, (v) CDR-L2 comprising the amino acid sequence of SEQ ID NO:29, and (vi) CDR-L3 comprising the amino acid sequence of SEQ ID NO:30, or
(b) a heavy chain variable region ($V_H$CEA) comprising (i) CDR-H1 comprising the amino acid sequence of SEQ ID NO:33, (ii) CDR-H2 comprising the amino acid sequence of SEQ ID NO:34, and (iii) CDR-H3 comprising the amino acid sequence of SEQ ID NO:35, and a light chain variable region ($V_L$CEA) comprising (iv) CDR-L1 comprising the amino acid sequence of SEQ ID NO:36, (v) CDR-L2 comprising the amino acid sequence of SEQ ID NO:37, and (vi) CDR-L3 comprising the amino acid sequence of SEQ ID NO:38, or
(c) a heavy chain variable region ($V_H$CEA) comprising (i) CDR-H1 comprising the amino acid sequence of SEQ ID NO:179, (ii) CDR-H2 comprising the amino acid sequence of SEQ ID NO:180, and (iii) CDR-H3 comprising the amino acid sequence of SEQ ID NO:181, and a light chain variable region ($V_L$CEA) comprising (iv) CDR-L1 comprising the amino acid sequence of SEQ ID NO:182, (v) CDR-L2 comprising the amino acid sequence of SEQ ID NO:183, and (vi) CDR-L3 comprising the amino acid sequence of SEQ ID NO:184, or
(d) a heavy chain variable region ($V_H$CEA) comprising (i) CDR-H1 comprising the amino acid sequence of SEQ ID NO:187, (ii) CDR-H2 comprising the amino acid sequence of SEQ ID NO:188, and (iii) CDR-H3 comprising the amino acid sequence of SEQ ID NO:189, and a light chain variable region ($V_L$CEA) comprising (iv) CDR-L1 comprising the amino acid sequence of SEQ ID NO:190, (v) CDR-L2 comprising the amino acid sequence of SEQ ID NO:191, and (vi) CDR-L3 comprising the amino acid sequence of SEQ ID NO:192.

In particular, provided is a a bispecific antigen binding molecule, wherein the antigen binding domain capable of specific binding to CEA comprises a heavy chain variable region ($V_H$CEA) comprising (i) CDR-H1 comprising the amino acid sequence of SEQ ID NO:25, (ii) CDR-H2 comprising the amino acid sequence of SEQ ID NO:26, and (iii) CDR-H3 comprising the amino acid sequence of SEQ ID NO:27, and a light chain variable region ($V_L$CEA) comprising (iv) CDR-L1 comprising the amino acid sequence of SEQ ID NO:28, (v) CDR-L2 comprising the amino acid sequence of SEQ ID NO:29, and (vi) CDR-L3 comprising the amino acid sequence of SEQ ID NO:30.

In another aspect, the antigen binding domain capable of specific binding to CEA comprises a heavy chain variable region ($V_H$CEA) comprising (i) CDR-H1 comprising the amino acid sequence of SEQ ID NO:33, (ii) CDR-H2 comprising the amino acid sequence of SEQ ID NO:34, and (iii) CDR-H3 comprising the amino acid sequence of SEQ ID NO:35, and a light chain variable region ($V_L$CEA) comprising (iv) CDR-L1 comprising the amino acid sequence of SEQ ID NO:36, (v) CDR-L2 comprising the amino acid sequence of SEQ ID NO:37, and (vi) CDR-L3 comprising the amino acid sequence of SEQ ID NO:38.

In a further aspect, the antigen binding domain capable of specific binding to CEA comprises a heavy chain variable region (V$_H$CEA) comprising (i) CDR-H1 comprising the amino acid sequence of SEQ ID NO:179, (ii) CDR-H2 comprising the amino acid sequence of SEQ ID NO:180, and (iii) CDR-H3 comprising the amino acid sequence of SEQ ID NO:181, and a light chain variable region (V$_L$CEA) comprising (iv) CDR-L1 comprising the amino acid sequence of SEQ ID NO:182, (v) CDR-L2 comprising the amino acid sequence of SEQ ID NO:183, and (vi) CDR-L3 comprising the amino acid sequence of SEQ ID NO:184.

In a further aspect, the antigen binding domain capable of specific binding to CEA comprises a heavy chain variable region (V$_H$CEA) comprising (i) CDR-H1 comprising the amino acid sequence of SEQ ID NO:187, (ii) CDR-H2 comprising the amino acid sequence of SEQ ID NO:188, and (iii) CDR-H3 comprising the amino acid sequence of SEQ ID NO:189, and a light chain variable region (V$_L$CEA) comprising (iv) CDR-L1 comprising the amino acid sequence of SEQ ID NO:190, (v) CDR-L2 comprising the amino acid sequence of SEQ ID NO:191, and (vi) CDR-L3 comprising the amino acid sequence of SEQ ID NO:192.

Particularly, provided is a bispecific antigen binding molecule, wherein the antigen binding domain capable of specific binding to Carcinoembryonic Antigen (CEA) comprises (a) a heavy chain variable region (V$_H$CEA) comprising an amino acid sequence that is at least about 95%, 96%, 97%, 98%, 99% or 100% identical to the amino acid sequence of SEQ ID NO:31, and a light chain variable region (V$_L$CEA) comprising an amino acid sequence that is at least about 95%, 96%, 97%, 98%, 99% or 100% identical to the amino acid sequence of SEQ ID NO:32, or (b) a heavy chain variable region (V$_H$CEA) comprising an amino acid sequence that is at least about 95%, 96%, 97%, 98%, 99% or 100% identical to the amino acid sequence of SEQ ID NO:39, and a light chain variable region (V$_L$CEA) comprising an amino acid sequence that is at least about 95%, 96%, 97%, 98%, 99% or 100% identical to the amino acid sequence of SEQ ID NO:40, or (c) a heavy chain variable region (V$_H$CEA) comprising an amino acid sequence that is at least about 95%, 96%, 97%, 98%, 99% or 100% identical to the amino acid sequence of SEQ ID NO:185, and a light chain variable region (V$_L$CEA) comprising an amino acid sequence that is at least about 95%, 96%, 97%, 98%, 99% or 100% identical to the amino acid sequence of SEQ ID NO:186, or (d) a heavy chain variable region (V$_H$CEA) comprising an amino acid sequence that is at least about 95%, 96%, 97%, 98%, 99% or 100% identical to the amino acid sequence of SEQ ID NO:193, and a light chain variable region (V$_L$CEA) comprising an amino acid sequence that is at least about 95%, 96%, 97%, 98%, 99% or 100% identical to the amino acid sequence of SEQ ID NO:194.

In one aspect, the antigen binding domain capable of specific binding to CEA comprises a heavy chain variable region VH comprising the amino acid sequence of SEQ ID NO: 31 and a light chain variable region comprising an amino acid sequence of SEQ ID NO: 32 or the antigen binding domain capable of specific binding to FAP comprises a heavy chain variable region VH comprising an amino acid sequence of SEQ ID NO:39 and a light chain variable region comprising an amino acid sequence of SEQ ID NO:40.

In a further aspect, the antigen binding domain capable of specific binding to CEA comprises a heavy chain variable region VH comprising the amino acid sequence of SEQ ID NO: 185 and a light chain variable region comprising an amino acid sequence of SEQ ID NO: 186 or the antigen binding domain capable of specific binding to FAP comprises a heavy chain variable region VH comprising an amino acid sequence of SEQ ID NO:193 and a light chain variable region comprising an amino acid sequence of SEQ ID NO:194.

Bispecific Antigen Binding Molecules Binding to 4-1BB and CEA

In another aspect, provided is a bispecific antigen binding molecule, wherein
(i) the antigen binding domain capable of specific binding to 4-1BB comprises a heavy chain variable region VH comprising the amino acid sequence of SEQ ID NO: 7 and a light chain variable region comprising an amino acid sequence of SEQ ID NO: 8 and
(ii) the antigen binding domain capable of specific binding to FAP comprises a heavy chain variable region VH comprising an amino acid sequence of SEQ ID NO:31 and a light chain variable region comprising an amino acid sequence of SEQ ID NO:32.

In a further aspect, provided is a bispecific antigen binding molecule, wherein
(i) the antigen binding domain capable of specific binding to 4-1BB comprises a heavy chain variable region VH comprising the amino acid sequence of SEQ ID NO: 7 and a light chain variable region comprising an amino acid sequence of SEQ ID NO: 8 and
(ii) the antigen binding domain capable of specific binding to FAP comprises a heavy chain variable region VH comprising an amino acid sequence of SEQ ID NO:39 and a light chain variable region comprising an amino acid sequence of SEQ ID NO:40.

In a further aspect, provided is a bispecific antigen binding molecule, wherein
(i) the antigen binding domain capable of specific binding to 4-1BB comprises a heavy chain variable region VH comprising the amino acid sequence of SEQ ID NO: 7 and a light chain variable region comprising an amino acid sequence of SEQ ID NO: 8 and
(ii) the antigen binding domain capable of specific binding to FAP comprises a heavy chain variable region VH comprising an amino acid sequence of SEQ ID NO:185 and a light chain variable region comprising an amino acid sequence of SEQ ID NO:186.

In another aspect, provided is a bispecific antigen binding molecule, wherein
(i) the antigen binding domain capable of specific binding to 4-1BB comprises a heavy chain variable region VH comprising the amino acid sequence of SEQ ID NO: 7 and a light chain variable region comprising an amino acid sequence of SEQ ID NO: 8 and
(ii) the antigen binding domain capable of specific binding to FAP comprises a heavy chain variable region VH comprising an amino acid sequence of SEQ ID NO:193 and a light chain variable region comprising an amino acid sequence of SEQ ID NO:194.

Bispecific Antigen Binding Molecules Wherein the Target Cell Antigen is CD19

In a particular aspect, the target cell antigen is CD19. CD19 binding moieties have been described for example in WO 2016/075278 A1 which is included by reference in its entirety. CD19 binding moieties of particular interest are described below.

In one aspect, the invention provides a bispecific antigen binding molecule, wherein the antigen binding domain capable of specific binding to CD19 comprises
(a) a heavy chain variable region (V$_H$CD19) comprising (i) CDR-H1 comprising the amino acid sequence of SEQ ID NO:155, (ii) CDR-H2 comprising the amino acid sequence of SEQ ID NO:156, and (iii) CDR-H3 comprising the amino acid sequence of SEQ ID NO:157, and a light chain variable region ($V_L$CD19) comprising (iv) CDR-L1 comprising the amino acid sequence of SEQ ID NO:158, (v) CDR-L2 comprising the amino acid sequence of SEQ ID NO:159, and (vi) CDR-L3 comprising the amino acid sequence of SEQ ID NO:160, or (b) a heavy chain variable region ($V_H$CD19) comprising (i) CDR-H1 comprising the amino acid sequence of SEQ ID NO:163, (ii) CDR-H2 comprising the amino acid sequence of SEQ ID NO:164, and (iii) CDR-H3 comprising the amino acid sequence of SEQ ID NO:165, and a light chain variable region ($V_L$CD19) comprising (iv) CDR-L1 comprising the amino acid sequence of SEQ ID NO:166, (v) CDR-L2 comprising the amino acid sequence of SEQ ID NO:167, and (vi) CDR-L3 comprising the amino acid sequence of SEQ ID NO:168.

In particular, provided is a a bispecific antigen binding molecule, wherein the antigen binding domain capable of specific binding to CD19 comprises a heavy chain variable region ($V_H$CD19) comprising (i) CDR-H1 comprising the amino acid sequence of SEQ ID NO:155, (ii) CDR-H2 comprising the amino acid sequence of SEQ ID NO:156, and (iii) CDR-H3 comprising the amino acid sequence of SEQ ID NO:157, and a light chain variable region ($V_L$CD19) comprising (iv) CDR-L1 comprising the amino acid sequence of SEQ ID NO:158, (v) CDR-L2 comprising the amino acid sequence of SEQ ID NO:159, and (vi) CDR-L3 comprising the amino acid sequence of SEQ ID NO:160.

In another aspect, the antigen binding domain capable of specific binding to CD19 comprises a heavy chain variable region ($V_H$CD19) comprising (i) CDR-H1 comprising the amino acid sequence of SEQ ID NO:163, (ii) CDR-H2 comprising the amino acid sequence of SEQ ID NO:164, and (iii) CDR-H3 comprising the amino acid sequence of SEQ ID NO:165, and a light chain variable region ($V_L$CD19) comprising (iv) CDR-L1 comprising the amino acid sequence of SEQ ID NO:166, (v) CDR-L2 comprising the amino acid sequence of SEQ ID NO:167, and (vi) CDR-L3 comprising the amino acid sequence of SEQ ID NO:168.

Particularly, provided is a bispecific antigen binding molecule, wherein the antigen binding domain capable of specific binding to CD19 comprises (a) a heavy chain variable region ($V_H$CD19) comprising an amino acid sequence that is at least about 95%, 96%, 97%, 98%, 99% or 100% identical to the amino acid sequence of SEQ ID NO:161, and a light chain variable region ($V_L$CD19) comprising an amino acid sequence that is at least about 95%, 96%, 97%, 98%, 99% or 100% identical to the amino acid sequence of SEQ ID NO:162, or (b) a heavy chain variable region ($V_H$CD19) comprising an amino acid sequence that is at least about 95%, 96%, 97%, 98%, 99% or 100% identical to the amino acid sequence of SEQ ID NO:169, and a light chain variable region ($V_L$CD19) comprising an amino acid sequence that is at least about 95%, 96%, 97%, 98%, 99% or 100% identical to the amino acid sequence of SEQ ID NO:170.

In one aspect, the antigen binding domain capable of specific binding to CD19 comprises a heavy chain variable region VH comprising the amino acid sequence of SEQ ID NO: 161 and a light chain variable region comprising an amino acid sequence of SEQ ID NO: 162 or the antigen binding domain capable of specific binding to FAP comprises a heavy chain variable region VH comprising an amino acid sequence of SEQ ID NO:169 and a light chain variable region comprising an amino acid sequence of SEQ ID NO:170.

Bispecific Antigen Binding Molecules Binding to 4-1BB and CD19

In another aspect, provided is a bispecific antigen binding molecule, wherein
(i) the antigen binding domain capable of specific binding to 4-1BB comprises a heavy chain variable region VH comprising the amino acid sequence of SEQ ID NO: 7 and a light chain variable region comprising an amino acid sequence of SEQ ID NO: 8 and
(ii) the antigen binding domain capable of specific binding to FAP comprises a heavy chain variable region VH comprising an amino acid sequence of SEQ ID NO:161 and a light chain variable region comprising an amino acid sequence of SEQ ID NO:162.

In a further aspect, provided is a bispecific antigen binding molecule, wherein
(i) the antigen binding domain capable of specific binding to 4-1BB comprises a heavy chain variable region VH comprising the amino acid sequence of SEQ ID NO: 7 and a light chain variable region comprising an amino acid sequence of SEQ ID NO: 8 and
(ii) the antigen binding domain capable of specific binding to FAP comprises a heavy chain variable region VH comprising an amino acid sequence of SEQ ID NO:169 and a light chain variable region comprising an amino acid sequence of SEQ ID NO:170.

Bispecific, Monovalent Antigen Binding Molecules (1+1 Format)

In one aspect, the invention relates to bispecific antigen binding molecules comprising (a) one antigen binding domain capable of specific binding to a 4-1BB, (b) one antigen binding domain capable of specific binding to a target cell antigen, and (c) a Fc domain composed of a first and a second subunit capable of stable association.

In a particular aspect, provided is a bispecific antigen binding molecule, wherein said molecule comprises
(a) a first Fab fragment capable of specific binding to 4-1BB,
(b) a second Fab fragment capable of specific binding to a target cell antigen, and
(c) a Fc domain composed of a first and a second subunit capable of stable association;
wherein the antigen binding domain capable of specific binding to 4-1BB comprises a heavy chain variable region ($V_H$4-1BB) comprising (i) CDR-H1 comprising the amino acid sequence of SEQ ID NO:1, (ii) CDR-H2 comprising the amino acid sequence of SEQ ID NO:2, and (iii) CDR-H3 comprising the amino acid sequence of SEQ ID NO:3, and a light chain variable region ($V_L$4-1BB) comprising (iv) CDR-L1 comprising the amino acid sequence of SEQ ID NO:4, (v) CDR-L2 comprising the amino acid sequence of SEQ ID NO:5, and (vi) CDR-L3 comprising the amino acid sequence of SEQ ID NO:6.

In one aspect, the target cell antigen is FAP. In one aspect, the invention relates to a bispecific antigen binding molecule, comprising
(a) a first Fab fragment capable of specific binding to 4-1BB,
(b) a second Fab fragment capable of specific binding FAP, and
(c) a Fc domain composed of a first and a second subunit capable of stable association;
wherein the antigen binding domain capable of specific binding to 4-1BB comprises a heavy chain variable region (V$_H$4-1BB) comprising (i) CDR-H1 comprising the amino acid sequence of SEQ ID NO:1, (ii) CDR-H2 comprising the amino acid sequence of SEQ ID NO:2, and (iii) CDR-H3 comprising the amino acid sequence of SEQ ID NO:3, and a light chain variable region (V$_L$4-1BB) comprising (iv) CDR-L1 comprising the amino acid sequence of SEQ ID NO:4, (v) CDR-L2 comprising the amino acid sequence of SEQ ID NO:5, and (vi) CDR-L3 comprising the amino acid sequence of SEQ ID NO:6.

In a particular aspect, the invention provides a bispecific antigen binding molecule comprising a first light chain comprising the amino acid sequence of SEQ ID NO:126, a second light chain comprising the amino acid sequence of SEQ ID NO:127, a first heavy chain comprising the amino acid sequence of SEQ ID NO:124, and a second heavy chain comprising the amino acid sequence of SEQ ID NO:125.

Bispecific antigen binding molecules bivalent for binding to 4-1BB and monovalent for binding to the target cell antigen (2+1 format)

In another aspect, the invention provides a bispecific antigen binding molecule comprising
(a) two antigen binding domains capable of specific binding to 4-1BB,
(b) one antigen binding domain capable of specific binding to a target cell antigen, and
(c) a Fc domain composed of a first and a second subunit capable of stable association;
wherein the antigen binding domain capable of specific binding to 4-1BB comprises a heavy chain variable region (V$_H$4-1BB) comprising (i) CDR-H1 comprising the amino acid sequence of SEQ ID NO:1, (ii) CDR-H2 comprising the amino acid sequence of SEQ ID NO:2, and (iii) CDR-H3 comprising the amino acid sequence of SEQ ID NO:3, and a light chain variable region (V$_L$4-1BB) comprising (iv) CDR-L1 comprising the amino acid sequence of SEQ ID NO:4, (v) CDR-L2 comprising the amino acid sequence of SEQ ID NO:5, and (vi) CDR-L3 comprising the amino acid sequence of SEQ ID NO:6.

Thus, provided is a bispecific antigen binding molecule, wherein the bispecific antigen binding molecule is bivalent for 4-1BB and monovalent for the target cell antigen.

In one aspect, the bispecific antigen binding molecule comprises
(a) two light chains and two heavy chains of an antibody comprising two Fab fragments capable of specific binding to 4-1BB and the Fc domain, and
(b) a VH and VL domain capable of specific binding to a target cell antigen, wherein the VH domain and the VL domain are each connected via a peptide linker to one of the C-termini of the two heavy chains.

In a particular aspect, the peptide linker comprises an amino acid sequence selected from SEQ ID NO:109, SEQ ID NO:110, SEQ ID NO:114 and SEQ ID NO:115. More particularly, the peptide linker comprises the SEQ ID NO:115.

In a particular aspect, the bispecific antigen binding molecule comprises
(a) two light chains and two heavy chains of an antibody comprising two Fab fragments capable of specific binding to 4-1BB and the Fc domain, and
(b) a VH and VL domain capable of specific binding to a target cell antigen, wherein the VH domain is connected via a peptide linker to the C-terminus of one of the heavy chains and wherein the VL domain is connected via a peptide linker to the C-terminus of the second heavy chain.

In another particular aspect, the bispecific antigen binding molecule comprises
(a) two light chains and two heavy chains of an antibody comprising two Fab fragments capable of specific binding to 4-1BB and the Fc domain, and
(b) a VH and VL domain capable of specific binding to a target cell antigen, wherein the VH domain is connected via a peptide linker to the C-terminus of the Fc knob heavy chain and wherein the VL domain is connected via a peptide linker to the C-terminus of the Fc hole heavy chain.

In one aspect, the invention relates to a bispecific antigen binding molecule, comprising (a) two Fab fragments capable of specific binding to 4-1BB, (b) a VH and a VL domain capable of specific binding to FAP, and (c) a Fc domain composed of a first and a second subunit capable of stable association.

In a particular aspect, the invention provides a bispecific antigen binding molecule comprising
(a) two light chains, each comprising the amino acid sequence of SEQ ID NO:46, a first heavy chain comprising the amino acid sequence of SEQ ID NO:44, and a second heavy chain comprising the amino acid sequence of SEQ ID NO:45, or
(b) two light chains, each comprising the amino acid sequence of SEQ ID NO:46, a first heavy chain comprising the amino acid sequence of SEQ ID NO:49, and a second heavy chain comprising the amino acid sequence of SEQ ID NO:50.

In another aspect, the invention relates to a bispecific antigen binding molecule, comprising (a) two Fab fragments capable of specific binding to 4-1BB, (b) a VH and a VL domain capable of specific binding to CEA, and (c) a Fc domain composed of a first and a second subunit capable of stable association.

In a particular aspect, the invention provides a bispecific antigen binding molecule comprising
(a) two light chains, each comprising the amino acid sequence of SEQ ID NO:46, a first heavy chain comprising the amino acid sequence of SEQ ID NO:65, and a second heavy chain comprising the amino acid sequence of SEQ ID NO:66, or
(b) two light chains, each comprising the amino acid sequence of SEQ ID NO:46, a first heavy chain comprising the amino acid sequence of SEQ ID NO:69, and a second heavy chain comprising the amino acid sequence of SEQ ID NO:70, or
(c) two light chains, each comprising the amino acid sequence of SEQ ID NO:46, a first heavy chain comprising the amino acid sequence of SEQ ID NO:73, and a second heavy chain comprising the amino acid sequence of SEQ ID NO:74, or
(d) two light chains, each comprising the amino acid sequence of SEQ ID NO:46, a first heavy chain comprising the amino acid sequence of SEQ ID NO:77, and a second heavy chain comprising the amino acid sequence of SEQ ID NO:78.

In a further particular aspect, the invention provides a bispecific antigen binding molecule comprising
(e) two light chains, each comprising the amino acid sequence of SEQ ID NO:46, a first heavy chain comprising the amino acid sequence of SEQ ID NO:137, and a second heavy chain comprising the amino acid sequence of SEQ ID NO:74, or
(f) two light chains, each comprising the amino acid sequence of SEQ ID NO:46, a first heavy chain comprising the amino acid sequence of SEQ ID NO:138, and a second heavy chain comprising the amino acid sequence of SEQ ID NO:78.

In a further aspect, the invention provides a bispecific antigen binding molecule comprising
(g) two light chains, each comprising the amino acid sequence of SEQ ID NO:46, a first heavy chain comprising the amino acid sequence of SEQ ID NO:195, and a second heavy chain comprising the amino acid sequence of SEQ ID NO:196, or
(h) two light chains, each comprising the amino acid sequence of SEQ ID NO:46, a first heavy chain comprising the amino acid sequence of SEQ ID NO:197, and a second heavy chain comprising the amino acid sequence of SEQ ID NO:198, or
(i) two light chains, each comprising the amino acid sequence of SEQ ID NO:46, a first heavy chain comprising the amino acid sequence of SEQ ID NO:199, and a second heavy chain comprising the amino acid sequence of SEQ ID NO:200, or
(j) two light chains, each comprising the amino acid sequence of SEQ ID NO:46, a first heavy chain comprising the amino acid sequence of SEQ ID NO:201, and a second heavy chain comprising the amino acid sequence of SEQ ID NO:202.

In a further aspect, the invention relates to a bispecific antigen binding molecule, comprising (a) two Fab fragments capable of specific binding to 4-1BB, (b) a VH and a VL domain capable of specific binding to CD19, and (c) a Fc domain composed of a first and a second subunit capable of stable association.

In a particular aspect, the invention provides a bispecific antigen binding molecule comprising
(a) two light chains, each comprising the amino acid sequence of SEQ ID NO:46, a first heavy chain comprising the amino acid sequence of SEQ ID NO:139, and a second heavy chain comprising the amino acid sequence of SEQ ID NO:140, or
(b) two light chains, each comprising the amino acid sequence of SEQ ID NO:46, a first heavy chain comprising the amino acid sequence of SEQ ID NO:141, and a second heavy chain comprising the amino acid sequence of SEQ ID NO:142, or
(c) two light chains, each comprising the amino acid sequence of SEQ ID NO:46, a first heavy chain comprising the amino acid sequence of SEQ ID NO:143, and a second heavy chain comprising the amino acid sequence of SEQ ID NO:144, or
(d) two light chains, each comprising the amino acid sequence of SEQ ID NO:46, a first heavy chain comprising the amino acid sequence of SEQ ID NO:145, and a second heavy chain comprising the amino acid sequence of SEQ ID NO:146.

Bispecific Antigen Binding Molecules Bivalent for Binding to 4-1BB and Monovalent for Binding to the Target Cell Antigen (2+1 crossFab Format)

In another aspect, the invention provides a bispecific antigen binding molecule comprising
(a) two antigen binding domains capable of specific binding to 4-1BB,
(b) one antigen binding domain capable of specific binding to a target cell antigen, and
(c) a Fc domain composed of a first and a second subunit capable of stable association; wherein the antigen binding domain capable of specific binding to a target cell antigen is a crossFab fragment; and
wherein the antigen binding domain capable of specific binding to 4-1BB comprises a heavy chain variable region ($V_H$4-1BB) comprising (i) CDR-H1 comprising the amino acid sequence of SEQ ID NO:1, (ii) CDR-H2 comprising the amino acid sequence of SEQ ID NO:2, and (iii) CDR-H3 comprising the amino acid sequence of SEQ ID NO:3, and a light chain variable region ($V_L$4-1BB) comprising (iv) CDR-L1 comprising the amino acid sequence of SEQ ID NO:4, (v) CDR-L2 comprising the amino acid sequence of SEQ ID NO:5, and (vi) CDR-L3 comprising the amino acid sequence of SEQ ID NO:6.

In one aspect, provided is a bispecific antigen binding molecule, wherein the two antigen binding domains capable of specific binding to 4-1BB are Fab fragments and the antigen binding domain capable of specific binding to a target cell antigen is a crossFab fragment.

In one aspect, the bispecific antigen binding molecule comprises
(a) two light chains and two heavy chains of an antibody comprising two Fab fragments capable of specific binding to 4-1BB and the Fc domain, and
(b) a crossFab fragment capable of specific binding to the target cell antigen which is connected via a peptide linker to the C-terminus of one of the two heavy chains.

In a particular aspect, the peptide linker comprises an amino acid sequence selected from SEQ ID NO:109, SEQ ID NO:110, SEQ ID NO:114 and SEQ ID NO:115. More particularly, the peptide linker comprises the SEQ ID NO:115.

In one aspect, the two heavy chains of an antibody comprising two Fab fragments capable of specific binding to 4-1BB comprise knob-into-hole mutations and the crossFab fragment capable of specific binding to the target cell antigen is connected via a peptide linker to the C-terminus of the heavy chain comprising the knob mutations. In another aspect, the crossFab fragment capable of specific binding to the target cell antigen is connected via a peptide linker to the C-terminus of the heavy chain comprising the hole mutations.

In a particular aspect, the bispecific antigen binding molecule comprises
(a) two light chains and two heavy chains of an antibody comprising two Fab fragments capable of specific binding to 4-1BB and the Fc domain, and
(b) a crossFab (CHCL) fragment capable of specific binding to the target cell antigen which is connected via a peptide linker to the C-terminus of one of the two heavy chains.

In another particular aspect, the bispecific antigen binding molecule comprises
(a) two light chains and two heavy chains of an antibody comprising two Fab fragments capable of specific binding to 4-1BB and the Fc domain, and
(b) a crossFab (VHVL) fragment capable of specific binding to the target cell antigen which is connected via a peptide linker to the C-terminus of one of the two heavy chains.

In a particular aspect, provided is a bispecific antigen binding molecule, wherein in the CL domains of the two Fab fragments that bind to 4-1BB the amino acid at position 123 (EU numbering) has been replaced by arginine (R) and the amino acid at position 124 (EU numbering) has been substituted by lysine (K), and wherein in the CH1 domains of the two Fab fragments that bind to 4-1BB the amino acids at position 147 (EU numbering) and at position 213 (EU numbering) have been substituted by glutamic acid (E).

In one aspect, the invention relates to a bispecific antigen binding molecule, comprising (a) two Fab fragments capable of specific binding to 4-1BB, (b) a crossFab fragment capable of specific binding to FAP, and (c) a Fc domain composed of a first and a second subunit capable of stable association.

In another aspect, the invention relates to a bispecific antigen binding molecule, comprising (a) two Fab fragments capable of specific binding to 4-1BB, (b) a crossFab fragment capable of specific binding to CEA, and (c) a Fc domain composed of a first and a second subunit capable of stable association.

In another aspect, provided is a bispecific antigen binding molecule, comprising
(a) two light chains, each comprising the amino acid sequence of SEQ ID NO:46, a first heavy chain comprising the amino acid sequence of SEQ ID NO:211, a second heavy chain comprising the amino acid sequence of SEQ ID NO:212, and a further light chain comprising the amino acid sequence of SEQ ID NO:213, or
(b) two light chains, each comprising the amino acid sequence of SEQ ID NO:216, a first heavy chain comprising the amino acid sequence of SEQ ID NO:214, a second heavy chain comprising the amino acid sequence of SEQ ID NO:215, and a further light chain comprising the amino acid sequence of SEQ ID NO:217.

In a further aspect, the invention relates to a bispecific antigen binding molecule, comprising (a) two Fab fragments capable of specific binding to 4-1BB, (b) a crossFab fragment capable of specific binding to CD19, and (c) a Fc domain composed of a first and a second subunit capable of stable association.

Bispecific Antigen Binding Molecules Tetravalent for Binding to 4-1BB and Monovalent for Binding to the Target Cell Antigen (4+1 Format)

In another aspect, the invention provides a bispecific antigen binding molecule comprising
(a) four antigen binding domains capable of specific binding to 4-1BB,
(b) one antigen binding domain capable of specific binding to a target cell antigen, and
(c) a Fc domain composed of a first and a second subunit capable of stable association;
wherein the antigen binding domain capable of specific binding to 4-1BB comprises a heavy chain variable region ($V_H$4-1BB) comprising (i) CDR-H1 comprising the amino acid sequence of SEQ ID NO:1, (ii) CDR-H2 comprising the amino acid sequence of SEQ ID NO:2, and (iii) CDR-H3 comprising the amino acid sequence of SEQ ID NO:3, and a light chain variable region ($V_L$4-1BB) comprising (iv) CDR-L1 comprising the amino acid sequence of SEQ ID NO:4, (v) CDR-L2 comprising the amino acid sequence of SEQ ID NO:5, and (vi) CDR-L3 comprising the amino acid sequence of SEQ ID NO:6.

Thus, provided is a bispecific antigen binding molecule, wherein the bispecific antigen binding molecule is tetravalent for 4-1BB and monovalent for the target cell antigen.

In one aspect, provided is a bispecific antigen binding molecule, wherein the four antigen binding domains capable of specific binding to 4-1BB are Fab fragments and each two thereof are fused to each other, optionally via a peptide linker. In a particular aspect, the peptide linker comprises the amino acid sequence of SEQ ID NO:110. More particularly, the antigen binding molecule comprises two heavy chains comprising each a VHCH1-peptide linker-VHCH1 fragment. In a particular aspect, the peptide linker has the amino acid sequence of SEQ ID NO:110.

In another aspect, a bispecific antigen binding molecule is provided, wherein the antigen binding domain capable of specific binding to a target cell antigen comprises a VH and VL domain and wherein the VH domain is connected via a peptide linker to the C-terminus of the first subunit of the Fc domain and the VL domain is connected via a peptide linker to the C-terminus of the second subunit of the Fc domain.

In a particular aspect, the bispecific antigen binding molecule comprises
(a) four light chains and two heavy chains of an antibody comprising two Fab fragments capable of specific binding to 4-1BB and the Fc domain, and
(b) a VH and VL domain capable of specific binding to a target cell antigen, wherein the VH domain is connected via a peptide linker to the C-terminus of one of the heavy chains and wherein the VL domain is connected via a peptide linker to the C-terminus of the second heavy chain.

In one aspect, the invention relates to a bispecific antigen binding molecule, comprising
(a) four Fab fragments capable of specific binding to 4-1BB,
(b) a VH and a VL domain capable of specific binding to FAP, and (c) a Fc domain composed of a first and a second subunit capable of stable association.

In a particular aspect, the invention provides a bispecific antigen binding molecule comprising
(a) four light chains, each comprising the amino acid sequence of SEQ ID NO:46, a first heavy chain comprising the amino acid sequence of SEQ ID NO:57, and a second heavy chain comprising the amino acid sequence of SEQ ID NO:58, or
(b) four light chains, each comprising the amino acid sequence of SEQ ID NO:46, a first heavy chain comprising the amino acid sequence of SEQ ID NO:61, and a second heavy chain comprising the amino acid sequence of SEQ ID NO:62.

In another aspect, the invention relates to a bispecific antigen binding molecule, comprising (a) four Fab fragments capable of specific binding to 4-1BB, (b) a VH and a VL domain capable of specific binding to CEA, and (c) a Fc domain composed of a first and a second subunit capable of stable association.

In a particular aspect, the invention provides a bispecific antigen binding molecule comprising
(a) four light chains, each comprising the amino acid sequence of SEQ ID NO:46, a first heavy chain comprising the amino acid sequence of SEQ ID NO:81, and a second heavy chain comprising the amino acid sequence of SEQ ID NO:82, or
(b) four light chains, each comprising the amino acid sequence of SEQ ID NO:46, a first heavy chain comprising the amino acid sequence of SEQ ID NO:85, and a second heavy chain comprising the amino acid sequence of SEQ ID NO:86, or
(c) four light chains, each comprising the amino acid sequence of SEQ ID NO:46, a first heavy chain comprising the amino acid sequence of SEQ ID NO:89, and a second heavy chain comprising the amino acid sequence of SEQ ID NO:90, or
(d) four light chains, each comprising the amino acid sequence of SEQ ID NO:46, a first heavy chain comprising the amino acid sequence of SEQ ID NO:93, and a second heavy chain comprising the amino acid sequence of SEQ ID NO:94.

In another aspect, the invention provides a bispecific antigen binding molecule comprising
(e) four light chains, each comprising the amino acid sequence of SEQ ID NO:46, a first heavy chain comprising the amino acid sequence of SEQ ID NO:203, and a second heavy chain comprising the amino acid sequence of SEQ ID NO:204, or
(f) four light chains, each comprising the amino acid sequence of SEQ ID NO:46, a first heavy chain comprising the amino acid sequence of SEQ ID NO:205, and a second heavy chain comprising the amino acid sequence of SEQ ID NO:206, or (g) four light chains, each comprising the amino acid sequence of SEQ ID NO:46, a first heavy chain comprising the amino acid sequence of SEQ ID NO:207, and a second heavy chain comprising the amino acid sequence of SEQ ID NO:208, or (h) four light chains, each comprising the amino acid sequence of SEQ ID NO:46, a first heavy chain comprising the amino acid sequence of SEQ ID NO:209, and a second heavy chain comprising the amino acid sequence of SEQ ID NO:210.

In a further aspect, the invention relates to a bispecific antigen binding molecule, comprising (a) four Fab fragments capable of specific binding to 4-1BB, (b) a VH and a VL domain capable of specific binding to CD19, and (c) a Fc domain composed of a first and a second subunit capable of stable association.

In a particular aspect, the invention provides a bispecific antigen binding molecule comprising (a) four light chains, each comprising the amino acid sequence of SEQ ID NO:46, a first heavy chain comprising the amino acid sequence of SEQ ID NO:147, and a second heavy chain comprising the amino acid sequence of SEQ ID NO:148, or (b) four light chains, each comprising the amino acid sequence of SEQ ID NO:46, a first heavy chain comprising the amino acid sequence of SEQ ID NO:149, and a second heavy chain comprising the amino acid sequence of SEQ ID NO:150, or (c) four light chains, each comprising the amino acid sequence of SEQ ID NO:46, a first heavy chain comprising the amino acid sequence of SEQ ID NO:151, and a second heavy chain comprising the amino acid sequence of SEQ ID NO:152, or (d) four light chains, each comprising the amino acid sequence of SEQ ID NO:46, a first heavy chain comprising the amino acid sequence of SEQ ID NO:153, and a second heavy chain comprising the amino acid sequence of SEQ ID NO:154.

Fc Domain Modifications Reducing Fc Receptor Binding and/or Effector Function

The bispecific antigen binding molecules of the invention further comprise a Fc domain composed of a first and a second subunit capable of stable association.

In certain aspects, one or more amino acid modifications may be introduced into the Fc region of an antibody provided herein, thereby generating an Fc region variant. The Fc region variant may comprise a human Fc region sequence (e.g., a human IgG1, IgG2, IgG3 or IgG4 Fc region) comprising an amino acid modification (e.g. a substitution) at one or more amino acid positions.

The Fc domain confers favorable pharmacokinetic properties to the bispecific antibodies of the invention, including a long serum half-life which contributes to good accumulation in the target tissue and a favorable tissue-blood distribution ratio. At the same time it may, however, lead to undesirable targeting of the bispecific antibodies of the invention to cells expressing Fc receptors rather than to the preferred antigen-bearing cells. Accordingly, in particular embodiments the Fc domain of the bispecific antibodies of the invention exhibits reduced binding affinity to an Fc receptor and/or reduced effector function, as compared to a native IgG Fc domain, in particular an IgG1 Fc domain or an IgG4 Fc domain. More particularly, the Fc domain is an IgG1 Fc domain.

In one such aspect the Fc domain (or the bispecific antigen binding molecule of the invention comprising said Fc domain) exhibits less than 50%, preferably less than 20%, more preferably less than 10% and most preferably less than 5% of the binding affinity to an Fc receptor, as compared to a native IgG1 Fc domain (or the bispecific antigen binding molecule of the invention comprising a native IgG1 Fc domain), and/or less than 50%, preferably less than 20%, more preferably less than 10% and most preferably less than 5% of the effector function, as compared to a native IgG1 Fc domain (or the bispecific antigen binding molecule of the invention comprising a native IgG1 Fc domain). In one aspect, the Fc domain (or the bispecific antigen binding molecule of the invention comprising said Fc domain) does not substantially bind to an Fc receptor and/or induce effector function. In a particular aspect the Fc receptor is an Fcγ receptor. In one aspect, the Fc receptor is a human Fc receptor. In one aspect, the Fc receptor is an activating Fc receptor. In a specific aspect, the Fc receptor is an activating human Fcγ receptor, more specifically human FcγRIIIa, FcγRI or FcγRIIa, most specifically human FcγRIIIa. In one aspect, the Fc receptor is an inhibitory Fc receptor. In a specific aspect, the Fc receptor is an inhibitory human Fcγ receptor, more specifically human FcγRIIB In one aspect the effector function is one or more of CDC, ADCC, ADCP, and cytokine secretion. In a particular aspect, the effector function is ADCC. In one aspect, the Fc domain exhibits substantially similar binding affinity to neonatal Fc receptor (FcRn), as compared to a native IgG1 Fc domain. Substantially similar binding to FcRn is achieved when the Fc domain (or the the bispecific antigen binding molecule of the invention comprising said Fc domain) exhibits greater than about 70%, particularly greater than about 80%, more particularly greater than about 90% of the binding affinity of a native IgG1 Fc domain (or the the bispecific antigen binding molecule of the invention comprising a native IgG1 Fc domain) to FcRn.

In a particular aspect, the Fc domain is engineered to have reduced binding affinity to an Fc receptor and/or reduced effector function, as compared to a non-engineered Fc domain. In a particular aspect, the Fc domain of the bispecific antigen binding molecule of the invention comprises one or more amino acid mutation that reduces the binding affinity of the Fc domain to an Fc receptor and/or effector function. Typically, the same one or more amino acid mutation is present in each of the two subunits of the Fc domain. In one aspect, the amino acid mutation reduces the binding affinity of the Fc domain to an Fc receptor. In another aspect, the amino acid mutation reduces the binding affinity of the Fc domain to an Fc receptor by at least 2-fold, at least 5-fold, or at least 10-fold. In one aspect, the bispecific antigen binding molecule of the invention comprising an engineered Fc domain exhibits less than 20%, particularly less than 10%, more particularly less than 5% of the binding affinity to an Fc receptor as compared to bispecific antibodies of the invention comprising a non-engineered Fc domain. In a particular aspect, the Fc receptor is an Fcγ receptor. In other aspects, the Fc receptor is a human Fc receptor. In one aspect, the Fc receptor is an inhibitory Fc receptor. In a specific aspect, the Fc receptor is an inhibitory human Fcγ receptor, more specifically human FcγRIIB In some aspects the Fc receptor is an activating Fc receptor. In a specific aspect, the Fc receptor is an activating human Fcγ receptor, more specifically human FcγRIIIa, FcγRI or FcγRIIa, most specifically human FcγRIIIa. Preferably, binding to each of these receptors is reduced. In some aspects, binding affinity to a complement component, specifically binding affinity to C1q, is also reduced. In one aspect, binding affinity to neonatal Fc receptor (FcRn) is not reduced. Substantially similar binding to FcRn, i.e. preservation of the binding affinity of the Fc domain to said receptor, is achieved when the Fc domain (or the bispecific antigen binding molecule of the invention comprising said Fc domain) exhibits greater than about 70% of the binding affinity of a non-engineered form of the Fc domain (or the bispecific antigen binding molecule of the invention comprising said non-engineered form of the Fc domain) to FcRn. The Fc domain, or the bispecific antigen binding molecule of the invention comprising said Fc domain, may exhibit greater than about 80% and even greater than about 90% of such affinity. In certain embodiments the Fc domain of the bispecific antigen binding molecule of the invention is engineered to have reduced effector function, as compared to a non-engineered Fc domain. The reduced effector function can include, but is not limited to, one or more of the following: reduced complement dependent cytotoxicity (CDC), reduced antibody-dependent cell-mediated cytotoxicity (ADCC), reduced antibody-dependent cellular phagocytosis (ADCP), reduced cytokine secretion, reduced immune complex-mediated antigen uptake by antigen-presenting cells, reduced binding to NK cells, reduced binding to macrophages, reduced binding to monocytes, reduced binding to polymorphonuclear cells, reduced direct signaling inducing apoptosis, reduced dendritic cell maturation, or reduced T cell priming.

Antibodies with reduced effector function include those with substitution of one or more of Fc region residues 238, 265, 269, 270, 297, 327 and 329 (U.S. Pat. No. 6,737,056). Such Fc mutants include Fc mutants with substitutions at two or more of amino acid positions 265, 269, 270, 297 and 327, including the so-called "DANA" Fc mutant with substitution of residues 265 and 297 to alanine (U.S. Pat. No. 7,332,581). Certain antibody variants with improved or diminished binding to FcRs are described. (e.g. U.S. Pat. No. 6,737,056; WO 2004/056312, and Shields, R. L. et al., J. Biol. Chem. 276 (2001) 6591-6604).

In one aspect of the invention, the Fc domain comprises an amino acid substitution at a position of E233, L234, L235, N297, P331 and P329. In some aspects, the Fc domain comprises the amino acid substitutions L234A and L235A ("LALA"). In one such embodiment, the Fc domain is an IgG1 Fc domain, particularly a human IgG1 Fc domain. In one aspect, the Fc domain comprises an amino acid substitution at position P329. In a more specific aspect, the amino acid substitution is P329A or P329G, particularly P329G. In one embodiment the Fc domain comprises an amino acid substitution at position P329 and a further amino acid substitution selected from the group consisting of E233P, L234A, L235A, L235E, N297A, N297D or P331S. In more particular embodiments the Fc domain comprises the amino acid mutations L234A, L235A and P329G ("P329G LALA"). The "P329G LALA" combination of amino acid substitutions almost completely abolishes Fcγ receptor binding of a human IgG1 Fc domain, as described in PCT Patent Application No. WO 2012/130831 A1. Said document also describes methods of preparing such mutant Fc domains and methods for determining its properties such as Fc receptor binding or effector functions. Such antibody is an IgG1 with mutations L234A and L235A or with mutations L234A, L235A and P329G (numbering according to EU index of Kabat et al, Kabat et al., Sequences of Proteins of Immunological Interest, 5th Ed. Public Health Service, National Institutes of Health, Bethesda, Md., 1991).

In one aspect, the Fc domain is an IgG4 Fc domain. In a more specific embodiment, the Fc domain is an IgG4 Fc domain comprising an amino acid substitution at position S228 (Kabat numbering), particularly the amino acid substitution S228P. In a more specific embodiment, the Fc domain is an IgG4 Fc domain comprising amino acid substitutions L235E and S228P and P329G. This amino acid substitution reduces in vivo Fab arm exchange of IgG4 antibodies (see Stubenrauch et al., Drug Metabolism and Disposition 38, 84-91 (2010)).

Antibodies with increased half lives and improved binding to the neonatal Fc receptor (FcRn), which is responsible for the transfer of maternal IgGs to the fetus (Guyer, R. L. et al., J. Immunol. 117 (1976) 587-593, and Kim, J. K. et al., J. Immunol. 24 (1994) 2429-2434), are described in US 2005/0014934. Those antibodies comprise an Fc region with one or more substitutions therein which improve binding of the Fc region to FcRn. Such Fc variants include those with substitutions at one or more of Fc region residues: 238, 256, 265, 272, 286, 303, 305, 307, 311, 312, 317, 340, 356, 360, 362, 376, 378, 380, 382, 413, 424 or 434, e.g., substitution of Fc region residue 434 (U.S. Pat. No. 7,371,826). See also Duncan, A. R. and Winter, G., Nature 322 (1988) 738-740; U.S. Pat. Nos. 5,648,260; 5,624,821; and WO 94/29351 concerning other examples of Fc region variants.

Binding to Fc receptors can be easily determined e.g. by ELISA, or by Surface Plasmon Resonance (SPR) using standard instrumentation such as a BIAcore instrument (GE Healthcare), and Fc receptors such as may be obtained by recombinant expression. A suitable such binding assay is described herein. Alternatively, binding affinity of Fc domains or cell activating bispecific antigen binding molecules comprising an Fc domain for Fc receptors may be evaluated using cell lines known to express particular Fc receptors, such as human NK cells expressing FcγIIIa receptor. Effector function of an Fc domain, or bispecific antigen binding molecules of the invention comprising an Fc domain, can be measured by methods known in the art. A suitable assay for measuring ADCC is described herein. Other examples of in vitro assays to assess ADCC activity of a molecule of interest are described in U.S. Pat. No. 5,500,362; Hellstrom et al. Proc Natl Acad Sci USA 83, 7059-7063 (1986) and Hellstrom et al., Proc Natl Acad Sci USA 82, 1499-1502 (1985); U.S. Pat. No. 5,821,337; Bruggemann et al., J Exp Med 166, 1351-1361 (1987). Alternatively, non-radioactive assays methods may be employed (see, for example, ACTI™ non-radioactive cytotoxicity assay for flow cytometry (CellTechnology, Inc. Mountain View, Calif.); and CytoTox 96® non-radioactive cytotoxicity assay (Promega, Madison, Wis.)). Useful effector cells for such assays include peripheral blood mononuclear cells (PBMC) and Natural Killer (NK) cells. Alternatively, or additionally, ADCC activity of the molecule of interest may be assessed in vivo, e.g. in a animal model such as that disclosed in Clynes et al., Proc Natl Acad Sci USA 95, 652-656 (1998).

The following section describes preferred aspects of the bispecific antigen binding molecules of the invention comprising Fc domain modifications reducing Fc receptor binding and/or effector function. In one aspect, the invention relates to the bispecific antigen binding molecule (a) at least one antigen binding domain capable of specific binding to 4-1BB, (b) at least one antigen binding domain capable of specific binding to a target cell antigen, and (c) a Fc domain composed of a first and a second subunit capable of stable association, wherein the Fc domain comprises one or more amino acid substitution that reduces the binding affinity of the antibody to an Fc receptor, in particular towards Fcγ receptor. In another aspect, the invention relates to the bispecific antigen binding molecule comprising (a) at least one antigen binding domain capable of specific binding to 4-1BB, (b) at least one antigen binding domain capable of specific binding to a target cell antigen, and (c) a Fc domain composed of a first and a second subunit capable of stable association, wherein the Fc domain comprises one or more amino acid substitution that reduces effector function. In particular aspect, the Fc domain is of human IgG1 subclass with the amino acid mutations L234A, L235A and P329G (numbering according to Kabat EU index).

Fc Domain Modifications Promoting Heterodimerization

The bispecific antigen binding molecules of the invention comprise different antigen-binding sites, fused to one or the other of the two subunits of the Fc domain, thus the two subunits of the Fc domain may be comprised in two non-identical polypeptide chains. Recombinant co-expression of these polypeptides and subsequent dimerization leads to several possible combinations of the two polypeptides. To improve the yield and purity of the bispecific antigen binding molecules of the invention in recombinant production, it will thus be advantageous to introduce in the Fc domain of the bispecific antigen binding molecules of the invention a modification promoting the association of the desired polypeptides.

Accordingly, in particular aspects the invention relates to the bispecific antigen binding molecule comprising (a) at least one antigen binding domain capable of specific binding to 4-1BB, (b) at least one antigen binding domain capable of specific binding to a target cell antigen, and (c) a Fc domain composed of a first and a second subunit capable of stable association, wherein the Fc domain comprises a modification promoting the association of the first and second subunit of the Fc domain. The site of most extensive protein-protein interaction between the two subunits of a human IgG Fc domain is in the CH3 domain of the Fc domain. Thus, in one aspect said modification is in the CH3 domain of the Fc domain.

In a specific aspect said modification is a so-called "knob-into-hole" modification, comprising a "knob" modification in one of the two subunits of the Fc domain and a "hole" modification in the other one of the two subunits of the Fc domain. Thus, the invention relates to the bispecific antigen binding molecule comprising (a) at least one antigen binding domain capable of specific binding to 4-1BB, (b) at least one antigen binding domain capable of specific binding to a target cell antigen, and (c) a Fc domain composed of a first and a second subunit capable of stable association, wherein the first subunit of the Fc domain comprises knobs and the second subunit of the Fc domain comprises holes according to the knobs into holes method. In a particular aspect, the first subunit of the Fc domain comprises the amino acid substitutions S354C and T366W (EU numbering) and the second subunit of the Fc domain comprises the amino acid substitutions Y349C, T366S and Y407V (numbering according to Kabat EU index).

The knob-into-hole technology is described e.g. in U.S. Pat. Nos. 5,731,168; 7,695,936; Ridgway et al., Prot Eng 9, 617-621 (1996) and Carter, J Immunol Meth 248, 7-15 (2001). Generally, the method involves introducing a protuberance ("knob") at the interface of a first polypeptide and a corresponding cavity ("hole") in the interface of a second polypeptide, such that the protuberance can be positioned in the cavity so as to promote heterodimer formation and hinder homodimer formation. Protuberances are constructed by replacing small amino acid side chains from the interface of the first polypeptide with larger side chains (e.g. tyrosine or tryptophan). Compensatory cavities of identical or similar size to the protuberances are created in the interface of the second polypeptide by replacing large amino acid side chains with smaller ones (e.g. alanine or threonine).

Accordingly, in one aspect, in the CH3 domain of the first subunit of the Fc domain of the bispecific antigen binding molecules of the invention an amino acid residue is replaced with an amino acid residue having a larger side chain volume, thereby generating a protuberance within the CH3 domain of the first subunit which is positionable in a cavity within the CH3 domain of the second subunit, and in the CH3 domain of the second subunit of the Fc domain an amino acid residue is replaced with an amino acid residue having a smaller side chain volume, thereby generating a cavity within the CH3 domain of the second subunit within which the protuberance within the CH3 domain of the first subunit is positionable. The protuberance and cavity can be made by altering the nucleic acid encoding the polypeptides, e.g. by site-specific mutagenesis, or by peptide synthesis. In a specific aspect, in the CH3 domain of the first subunit of the Fc domain the threonine residue at position 366 is replaced with a tryptophan residue (T366W), and in the CH3 domain of the second subunit of the Fc domain the tyrosine residue at position 407 is replaced with a valine residue (Y407V). In one aspect, in the second subunit of the Fc domain additionally the threonine residue at position 366 is replaced with a serine residue (T366S) and the leucine residue at position 368 is replaced with an alanine residue (L368A).

In yet a further aspect, in the first subunit of the Fc domain additionally the serine residue at position 354 is replaced with a cysteine residue (S354C), and in the second subunit of the Fc domain additionally the tyrosine residue at position 349 is replaced by a cysteine residue (Y349C). Introduction of these two cysteine residues results in formation of a disulfide bridge between the two subunits of the Fc domain, further stabilizing the dimer (Carter (2001), J Immunol Methods 248, 7-15). In a particular aspect, the first subunit of the Fc domain comprises the amino acid substitutions S354C and T366W (EU numbering) and the second subunit of the Fc domain comprises the amino acid substitutions Y349C, T366S and Y407V (numbering according to Kabat EU index).

In an alternative aspect, a modification promoting association of the first and the second subunit of the Fc domain comprises a modification mediating electrostatic steering effects, e.g. as described in PCT publication WO 2009/089004. Generally, this method involves replacement of one or more amino acid residues at the interface of the two Fc domain subunits by charged amino acid residues so that homodimer formation becomes electrostatically unfavorable but heterodimerization electrostatically favorable.

The C-terminus of the heavy chain of the bispecific antibody as reported herein can be a complete C-terminus ending with the amino acid residues PGK. The C-terminus of the heavy chain can be a shortened C-terminus in which one or two of the C terminal amino acid residues have been removed. In one preferred aspect, the C-terminus of the heavy chain is a shortened C-terminus ending PG. In one aspect of all aspects as reported herein, a bispecific antibody comprising a heavy chain including a C-terminal CH3 domain as specified herein, comprises the C-terminal glycine-lysine dipeptide (G446 and K447, numbering according to Kabat EU index). In one embodiment of all aspects as reported herein, a bispecific antibody comprising a heavy chain including a C-terminal CH3 domain, as specified herein, comprises a C-terminal glycine residue (G446, numbering according to Kabat EU index).

Modifications in the CH1/CL Domains

To further improve correct pairing, the bispecific antigen binding molecules can contain different charged amino acid substitutions (so-called "charged residues"). These modifications are introduced in the crossed or non-crossed CH1 and CL domains. In a particular aspect, the invention relates to a bispecific antigen binding molecule, wherein in at least one of CL domains the amino acid at position 123 (EU numbering) has been replaced by arginine (R) and the amino acid at position 124 (EU numbering) has been substituted by lysine (K) and wherein in at least one of the CH1 domains the amino acids at position 147 (EU numbering) and at position 213 (EU numbering) have been substituted by glutamic acid (E).

More particularly, the invention relates to a bispecific antigen binding molecule, wherein in the CL domain of the Fab domain that binds to 4-1BB the amino acid at position 123 (EU numbering) has been replaced by arginine (R) and the amino acid at position 124 (EU numbering) has been substituted by lysine (K), and wherein in the CH1 domain of the Fab domain that binds to 4-1BB the amino acids at position 147 (EU numbering) and at position 213 (EU numbering) have been substituted by glutamic acid (E).

Modifications in the Fab Domains

In one aspect, the invention relates to a bispecific antigen binding molecule comprising (a) a first Fab fragment capable of specific binding to 4-1BB, (b) a second Fab fragment capable of specific binding to a target cell antigen, and (c) a Fc domain composed of a first and a second subunit capable of stable association, wherein in one of the Fab fragments either the variable domains VH and VL or the constant domains CH1 and CL are exchanged. The bispecific antibodies are prepared according to the Crossmab technology.

Multispecific antibodies with a domain replacement/exchange in one binding arm (CrossMab VH-VL or CrossMab CH-CL) are described in detail in WO2009/080252 and Schaefer, W. et al, PNAS, 108 (2011) 11187-1191. They clearly reduce the byproducts caused by the mismatch of a light chain against a first antigen with the wrong heavy chain against the second antigen (compared to approaches without such domain exchange).

In one aspect, the invention relates to a bispecific antigen binding molecule comprising (a) a first Fab fragment capable of specific binding to 4-1BB, (b) a second Fab fragment capable of specific binding to a target cell antigen, and (c) a Fc domain composed of a first and a second subunit capable of stable association, wherein in one of the Fab fragments the constant domains CL and CH1 are replaced by each other so that the CH1 domain is part of the light chain and the CL domain is part of the heavy chain (CH-CL crossmab). In another aspect, in one of the Fab fragments the variable domains VL and VH are replaced by each other so that the VH domain is part of the light chain and the VL domain is part of the heavy chain (VH-VL crossmab). More particularly, in the second Fab fragment capable of specific binding to a target cell antigen the constant domains CL and CH1 are replaced by each other so that the CH1 domain is part of the light chain and the CL domain is part of the heavy chain.

In a particular aspect, the invention relates a bispecific antigen binding molecule comprising (a) a first Fab fragment capable of specific binding to 4-1BB, (b) a second Fab fragment capable of specific binding to a target cell antigen, wherein the constant domains CL and CH1 are replaced by each other so that the CH1 domain is part of the light chain and the CL domain is part of the heavy chain. Such a molecule is called a monovalent bispecific antigen binding molecule.

In another aspect, the invention relates to a bispecific antigen binding molecule, comprising (a) two light chains and two heavy chains of an antibody comprising two Fab fragments capable of specific binding to 4-1BB and the Fc domain, and (b) two additional Fab fragments capable of specific binding to a target cell antigen, wherein said additional Fab fragments are each connected via a peptide linker to the C-terminus of the heavy chains of (a). In a particular aspect, the additional Fab fragments are Fab fragments, wherein the variable domains VL and VH are replaced by each other so that the VH domain is part of the light chain and the VL domain is part of the heavy chain.

Thus, in one aspect, the invention comprises a bispecific antigen binding molecule, comprising (a) two light chains and two heavy chains of an antibody comprising two Fab fragments capable of specific binding to 4-1BB and the Fc domain, and (b) two additional Fab fragments capable of specific binding to a target cell antigen, wherein said two additional Fab fragments capable of specific binding to a target cell antigen are crossover Fab fragments wherein the variable domains VL and VH are replaced by each other and the VL-CH chains are each connected via a peptide linker to the C-terminus of the heavy chains of (a).

In another aspect, the invention relates to a bispecific antigen binding molecule, comprising (a) two light chains and two heavy chains of an antibody comprising two Fab fragments capable of specific binding to 4-1BB and the Fc domain, and (b) one additional Fab fragment capable of specific binding to a target cell antigen, wherein said additional Fab fragment is connected via a peptide linker to the C-terminus of one of the heavy chains of (a). In a particular aspect, the additional Fab fragment is a Fab fragment, wherein the variable domains VL and VH are replaced by each other so that the VH domain is part of the light chain and the VL domain is part of the heavy chain. In another aspect, the additional Fab fragment is a Fab fragment, wherein the constant domains CL and CH1 are replaced by each other so that the CH1 domain is part of the light chain and the CL domain is part of the heavy chain.

Polynucleotides

The invention further provides isolated polynucleotides encoding a bispecific antigen binding molecule as described herein or a fragment thereof.

The isolated polynucleotides encoding bispecific antigen binding molecules of the invention may be expressed as a single polynucleotide that encodes the entire antigen binding molecule or as multiple (e.g., two or more) polynucleotides that are co-expressed. Polypeptides encoded by polynucleotides that are co-expressed may associate through, e.g., disulfide bonds or other means to form a functional antigen binding molecule. For example, the light chain portion of an immunoglobulin may be encoded by a separate polynucleotide from the heavy chain portion of the immunoglobulin. When co-expressed, the heavy chain polypeptides will associate with the light chain polypeptides to form the immunoglobulin.

In some aspects, the isolated polynucleotide encodes a polypeptide comprised in the bispecific molecule according to the invention as described herein.

In one aspect, the present invention is directed to an isolated polynucleotide encoding a bispecific antigen binding molecule, comprising (a) at least one antigen binding domain capable of specific binding to 4-1BB, (b) at least one antigen binding domain capable of specific binding to a target cell antigen, and (c) a Fc domain composed of a first and a second subunit capable of stable association, wherein the antigen binding domain capable of specific binding to 4-1BB comprises
a heavy chain variable region ($V_H$4-1BB) comprising (i) CDR-H1 comprising the amino acid sequence of SEQ ID NO:1, (ii) CDR-H2 comprising the amino acid sequence of SEQ ID NO:2, and (iii) CDR-H3 comprising the amino acid sequence of SEQ ID NO:3, and a light chain variable region ($V_L$4-1BB) comprising (iv) CDR-L1 comprising the amino acid sequence of SEQ ID NO:4, (v) CDR-L2 comprising the amino acid sequence of SEQ ID NO:5, and (vi) CDR-L3 comprising the amino acid sequence of SEQ ID NO:6.

In certain embodiments the polynucleotide or nucleic acid is DNA. In other embodiments, a polynucleotide of the present invention is RNA, for example, in the form of messenger RNA (mRNA). RNA of the present invention may be single stranded or double stranded.

Recombinant Methods

Bispecific antigen binding molecules of the invention may be obtained, for example, by recombinant production. For recombinant production one or more polynucleotide encoding the bispecific antigen binding molecule or polypeptide fragments thereof are provided. The one or more polynucleotide encoding the bispecific antigen binding molecule are isolated and inserted into one or more vectors for further cloning and/or expression in a host cell. Such polynucleotide may be readily isolated and sequenced using conventional procedures. In one aspect of the invention, a vector, preferably an expression vector, comprising one or more of the polynucleotides of the invention is provided. Methods which are well known to those skilled in the art can be used to construct expression vectors containing the coding sequence of the bispecific antigen binding molecule (fragment) along with appropriate transcriptional/translational control signals. These methods include in vitro recombinant DNA techniques, synthetic techniques and in vivo recombination/genetic recombination. See, for example, the techniques described in Maniatis et al., MOLECULAR CLONING: A LABORATORY MANUAL, Cold Spring Harbor Laboratory, N.Y. (1989); and Ausubel et al., CURRENT PROTOCOLS IN MOLECULAR BIOLOGY, Greene Publishing Associates and Wiley Interscience, N.Y. (1989). The expression vector can be part of a plasmid, virus, or may be a nucleic acid fragment. The expression vector includes an expression cassette into which the polynucleotide encoding the bispecific antigen binding molecule or polypeptide fragments thereof (i.e. the coding region) is cloned in operable association with a promoter and/or other transcription or translation control elements. As used herein, a "coding region" is a portion of nucleic acid which consists of codons translated into amino acids. Although a "stop codon" (TAG, TGA, or TAA) is not translated into an amino acid, it may be considered to be part of a coding region, if present, but any flanking sequences, for example promoters, ribosome binding sites, transcriptional terminators, introns, 5' and 3' untranslated regions, and the like, are not part of a coding region. Two or more coding regions can be present in a single polynucleotide construct, e.g. on a single vector, or in separate polynucleotide constructs, e.g. on separate (different) vectors. Furthermore, any vector may contain a single coding region, or may comprise two or more coding regions, e.g. a vector of the present invention may encode one or more polypeptides, which are post- or co-translationally separated into the final proteins via proteolytic cleavage. In addition, a vector, polynucleotide, or nucleic acid of the invention may encode heterologous coding regions, either fused or unfused to a polynucleotide encoding the bispecific antigen binding molecule of the invention or polypeptide fragments thereof, or variants or derivatives thereof. Heterologous coding regions include without limitation specialized elements or motifs, such as a secretory signal peptide or a heterologous functional domain. An operable association is when a coding region for a gene product, e.g. a polypeptide, is associated with one or more regulatory sequences in such a way as to place expression of the gene product under the influence or control of the regulatory sequence(s). Two DNA fragments (such as a polypeptide coding region and a promoter associated therewith) are "operably associated" if induction of promoter function results in the transcription of mRNA encoding the desired gene product and if the nature of the linkage between the two DNA fragments does not interfere with the ability of the expression regulatory sequences to direct the expression of the gene product or interfere with the ability of the DNA template to be transcribed. Thus, a promoter region would be operably associated with a nucleic acid encoding a polypeptide if the promoter was capable of effecting transcription of that nucleic acid. The promoter may be a cell-specific promoter that directs substantial transcription of the DNA only in predetermined cells. Other transcription control elements, besides a promoter, for example enhancers, operators, repressors, and transcription termination signals, can be operably associated with the polynucleotide to direct cell-specific transcription.

Suitable promoters and other transcription control regions are disclosed herein. A variety of transcription control regions are known to those skilled in the art. These include, without limitation, transcription control regions, which function in vertebrate cells, such as, but not limited to, promoter and enhancer segments from cytomegaloviruses (e.g. the immediate early promoter, in conjunction with intron-A), simian virus 40 (e.g. the early promoter), and retroviruses (such as, e.g. Rous sarcoma virus). Other transcription control regions include those derived from vertebrate genes such as actin, heat shock protein, bovine growth hormone and rabbit â-globin, as well as other sequences capable of controlling gene expression in eukaryotic cells. Additional suitable transcription control regions include tissue-specific promoters and enhancers as well as inducible promoters (e.g. promoters inducible tetracyclins). Similarly, a variety of translation control elements are known to those of ordinary skill in the art. These include, but are not limited to ribosome binding sites, translation initiation and termination codons, and elements derived from viral systems (particularly an internal ribosome entry site, or IRES, also referred to as a CITE sequence). The expression cassette may also include other features such as an origin of replication, and/or chromosome integration elements such as retroviral long terminal repeats (LTRs), or adeno-associated viral (AAV) inverted terminal repeats (ITRs).

Polynucleotide and nucleic acid coding regions of the present invention may be associated with additional coding regions which encode secretory or signal peptides, which direct the secretion of a polypeptide encoded by a polynucleotide of the present invention. For example, if secretion of the bispecific antigen binding molecule or polypeptide fragments thereof is desired, DNA encoding a signal sequence may be placed upstream of the nucleic acid encoding the bispecific antigen binding molecule of the invention or polypeptide fragments thereof. According to the signal hypothesis, proteins secreted by mammalian cells have a signal peptide or secretory leader sequence which is cleaved from the mature protein once export of the growing protein chain across the rough endoplasmic reticulum has been initiated. Those of ordinary skill in the art are aware that polypeptides secreted by vertebrate cells generally have a signal peptide fused to the N-terminus of the polypeptide, which is cleaved from the translated polypeptide to produce a secreted or "mature" form of the polypeptide. In certain embodiments, the native signal peptide, e.g. an immunoglobulin heavy chain or light chain signal peptide is used, or a functional derivative of that sequence that retains the ability to direct the secretion of the polypeptide that is operably associated with it. Alternatively, a heterologous mammalian signal peptide, or a functional derivative thereof, may be used. For example, the wild-type leader sequence may be substituted with the leader sequence of human tissue plasminogen activator (TPA) or mouse β-glucuronidase.

DNA encoding a short protein sequence that could be used to facilitate later purification (e.g. a histidine tag) or assist in labeling the fusion protein may be included within or at the ends of the polynucleotide encoding a bispecific antigen binding molecule of the invention or polypeptide fragments thereof.

In a further aspect of the invention, a host cell comprising one or more polynucleotides of the invention is provided. In certain aspects, a host cell comprising one or more vectors of the invention is provided. The polynucleotides and vectors may incorporate any of the features, singly or in combination, described herein in relation to polynucleotides and vectors, respectively. In one aspect, a host cell comprises (e.g. has been transformed or transfected with) a vector comprising a polynucleotide that encodes (part of) a bispecific antigen binding molecule of the invention of the invention. As used herein, the term "host cell" refers to any kind of cellular system which can be engineered to generate the fusion proteins of the invention or fragments thereof. Host cells suitable for replicating and for supporting expression of antigen binding molecules are well known in the art. Such cells may be transfected or transduced as appropriate with the particular expression vector and large quantities of vector containing cells can be grown for seeding large scale fermenters to obtain sufficient quantities of the antigen binding molecule for clinical applications. Suitable host cells include prokaryotic microorganisms, such as E. coli, or various eukaryotic cells, such as Chinese hamster ovary cells (CHO), insect cells, or the like. For example, polypeptides may be produced in bacteria in particular when glycosylation is not needed. After expression, the polypeptide may be isolated from the bacterial cell paste in a soluble fraction and can be further purified. In addition to prokaryotes, eukaryotic microbes such as filamentous fungi or yeast are suitable cloning or expression hosts for polypeptide-encoding vectors, including fungi and yeast strains whose glycosylation pathways have been "humanized", resulting in the production of a polypeptide with a partially or fully human glycosylation pattern. See Gerngross, Nat Biotech 22, 1409-1414 (2004), and Li et al., Nat Biotech 24, 210-215 (2006).

Suitable host cells for the expression of (glycosylated) polypeptides are also derived from multicellular organisms (invertebrates and vertebrates). Examples of invertebrate cells include plant and insect cells. Numerous baculoviral strains have been identified which may be used in conjunction with insect cells, particularly for transfection of *Spodoptera frugiperda* cells. Plant cell cultures can also be utilized as hosts. See e.g. U.S. Pat. Nos. 5,959,177, 6,040,498, 6,420,548, 7,125,978, and 6,417,429 (describing PLANTIBODIES™ technology for producing antibodies in transgenic plants). Vertebrate cells may also be used as hosts. For example, mammalian cell lines that are adapted to grow in suspension may be useful. Other examples of useful mammalian host cell lines are monkey kidney CV1 line transformed by SV40 (COS-7); human embryonic kidney line (293 or 293T cells as described, e.g., in Graham et al., J Gen Virol 36, 59 (1977)), baby hamster kidney cells (BHK), mouse sertoli cells (TM4 cells as described, e.g., in Mather, Biol Reprod 23, 243-251 (1980)), monkey kidney cells (CV1), African green monkey kidney cells (VERO-76), human cervical carcinoma cells (HELA), canine kidney cells (MDCK), buffalo rat liver cells (BRL 3A), human lung cells (W138), human liver cells (Hep G2), mouse mammary tumor cells (MMT 060562), TRI cells (as described, e.g., in Mather et al., Annals N.Y. Acad Sci 383, 44-68 (1982)), MRC 5 cells, and FS4 cells. Other useful mammalian host cell lines include Chinese hamster ovary (CHO) cells, including dhfr-CHO cells (Urlaub et al., Proc Natl Acad Sci USA 77, 4216 (1980)); and myeloma cell lines such as Y0, NS0, P3X63 and Sp2/0. For a review of certain mammalian host cell lines suitable for protein production, see, e.g., Yazaki and Wu, Methods in Molecular Biology, Vol. 248 (B. K. C. Lo, ed., Humana Press, Totowa, N.J.), pp. 255-268 (2003). Host cells include cultured cells, e.g., mammalian cultured cells, yeast cells, insect cells, bacterial cells and plant cells, to name only a few, but also cells comprised within a transgenic animal, transgenic plant or cultured plant or animal tissue. In one embodiment, the host cell is a eukaryotic cell, preferably a mammalian cell, such as a Chinese Hamster Ovary (CHO) cell, a human embryonic kidney (HEK) cell or a lymphoid cell (e.g., Y0, NS0, Sp20 cell). Standard technologies are known in the art to express foreign genes in these systems. Cells expressing a polypeptide comprising either the heavy or the light chain of an immunoglobulin, may be engineered so as to also express the other of the immunoglobulin chains such that the expressed product is an immunoglobulin that has both a heavy and a light chain.

In one aspect, a method of producing a bispecific antigen binding molecule of the invention or polypeptide fragments thereof is provided, wherein the method comprises culturing a host cell comprising polynucleotides encoding the bispecific antigen binding molecule of the invention or polypeptide fragments thereof, as provided herein, under conditions suitable for expression of the bispecific antigen binding molecule of the invention or polypeptide fragments thereof, and recovering the bispecific antigen binding molecule of the invention or polypeptide fragments thereof from the host cell (or host cell culture medium).

Bispecific molecules of the invention prepared as described herein may be purified by art-known techniques such as high performance liquid chromatography, ion exchange chromatography, gel electrophoresis, affinity chromatography, size exclusion chromatography, and the like. The actual conditions used to purify a particular protein will depend, in part, on factors such as net charge, hydrophobicity, hydrophilicity etc., and will be apparent to those having skill in the art. For affinity chromatography purification an antibody, ligand, receptor or antigen can be used to which the bispecific antigen binding molecule binds. For example, for affinity chromatography purification of fusion proteins of the invention, a matrix with protein A or protein G may be used. Sequential Protein A or G affinity chromatography and size exclusion chromatography can be used to isolate an antigen binding molecule essentially as described in the examples. The purity of the bispecific antigen binding molecule or fragments thereof can be determined by any of a variety of well-known analytical methods including gel electrophoresis, high pressure liquid chromatography, and the like. For example, the bispecific antigen binding molecules expressed as described in the Examples were shown to be intact and properly assembled as demonstrated by reducing and non-reducing SDS-PAGE.

Assays

The antigen binding molecules provided herein may be identified, screened for, or characterized for their physical/chemical properties and/or biological activities by various assays known in the art.

1. Affinity Assays

The affinity of the bispecific antigen binding molecules, antibodies and antibody fragments provided herein for 4-1BB and the target cell antigen can be determined in accordance with the methods set forth in the examples by surface plasmon resonance (SPR), using standard instrumentation such as a BIAcore instrument (GE Healthcare), and receptors or target proteins such as may be obtained by recombinant expression. The affinity of the bispecific antigen binding molecule for the target cell antigen can also be determined by surface plasmon resonance (SPR), using standard instrumentation such as a BIAcore instrument (GE Healthcare), and receptors or target proteins such as may be obtained by recombinant expression. A specific illustrative and exemplary embodiment for measuring binding affinity is described in Example 1.2. According to one aspect, $K_D$ is measured by surface plasmon resonance using a BIACORE® T100 machine (GE Healthcare) at 25° C.

2. Binding Assays and Other Assays

Binding of the bispecific antigen binding molecule provided herein to the corresponding receptor expressing cells may be evaluated using cell lines expressing the particular receptor or target antigen, for example by flow cytometry (FACS). In one aspect, peripheral blood mononuclear cells (PBMCs) expressing 4-1BB are used in the binding assay. These cells are used directly after isolation (naïve PMBCs) or after stimulation (activated PMBCs). In another aspect, activated mouse splenocytes (expressing 4-1BB) were used to demonstrate the binding of the bispecific antigen binding molecule or antibody of the invention to 4-1BB expressing cells. In a further aspect, PBMC isolated from heparinized blood of healthy *Macaca fascicularis* were used to show of the bispecific antigen binding molecule or antibody to the corresponding cynomolgus 4-1BB expressing cells.

In a further aspect, cancer cell lines expressing the target cell antigen, for example FAP or CEA, were used to demonstrate the binding of the antigen binding molecules to the target cell antigen.

In another aspect, competition assays may be used to identify an antigen binding molecule that competes with a specific antibody or antigen binding molecule for binding to the target or 4-1BB, respectively. In certain embodiments, such a competing antigen binding molecule binds to the same epitope (e.g., a linear or a conformational epitope) that is bound by a specific anti-target antibody or a specific anti-4-1BB antibody. Detailed exemplary methods for mapping an epitope to which an antibody binds are provided in Morris (1996) "Epitope Mapping Protocols," in *Methods in Molecular Biology* vol. 66 (Humana Press, Totowa, N.J.).

3. Activity Assays

In one aspect, assays are provided for identifying bispecific antigen binding molecules that bind to a specific target cell antigen and to 4-1BB having biological activity. Biological activity may include, e.g., agonistic signalling through 4-1BB on cells expressing the target cell antigen. Bispecific antigen binding molecules identified by the assays as having such biological activity in vitro are also provided.

In certain aspects, a bispecific antigen binding molecule of the invention is tested for such biological activity. Furthermore, assays for detecting cell lysis (e.g. by measurement of LDH release), induced apoptosis kinetics (e.g. by measurement of Caspase 3/7 activity) or apoptosis (e.g. using the TUNEL assay) are well known in the art. In addition the biological activity of such complexes can be assessed by evaluating their effects on survival, proliferation and lymphokine secretion of various lymphocyte subsets such as NK cells, NKT-cells or γδT-cells or assessing their capacity to modulate phenotype and function of antigen presenting cells such as dendritic cells, monocytes/macrophages or B-cells.

Pharmaceutical Compositions, Formulations and Routes of Administration

In a further aspect, the invention provides pharmaceutical compositions comprising any of the bispecific antigen binding molecules provided herein, e.g., for use in any of the below therapeutic methods. In one embodiment, a pharmaceutical composition comprises any of the bispecific antigen binding molecules provided herein and at least one pharmaceutically acceptable excipient. In another embodiment, a pharmaceutical composition comprises any of the bispecific antigen binding molecules provided herein and at least one additional therapeutic agent, e.g., as described below.

Pharmaceutical compositions of the present invention comprise a therapeutically effective amount of one or more bispecific antigen binding molecules dissolved or dispersed in a pharmaceutically acceptable excipient. The phrases "pharmaceutical or pharmacologically acceptable" refers to molecular entities and compositions that are generally non-toxic to recipients at the dosages and concentrations employed, i.e. do not produce an adverse, allergic or other untoward reaction when administered to an animal, such as, for example, a human, as appropriate. The preparation of a pharmaceutical composition that contains at least one bispecific antigen binding molecule according to the invention and optionally an additional active ingredient will be known to those of skill in the art in light of the present disclosure, as exemplified by Remington's Pharmaceutical Sciences, 18th Ed. Mack Printing Company, 1990, incorporated herein by reference. In particular, the compositions are lyophilized formulations or aqueous solutions. As used herein, "pharmaceutically acceptable excipient" includes any and all solvents, buffers, dispersion media, coatings, surfactants, antioxidants, preservatives (e.g. antibacterial agents, antifungal agents), isotonic agents, salts, stabilizers and combinations thereof, as would be known to one of ordinary skill in the art.

Parenteral compositions include those designed for administration by injection, e.g. subcutaneous, intradermal, intralesional, intravenous, intraarterial intramuscular, intrathecal or intraperitoneal injection. For injection, the bispecific antigen binding molecules of the invention may be formulated in aqueous solutions, preferably in physiologically compatible buffers such as Hanks' solution, Ringer's solution, or physiological saline buffer. The solution may contain formulatory agents such as suspending, stabilizing and/or dispersing agents. Alternatively, the bispecific antigen binding molecules may be in powder form for constitution with a suitable vehicle, e.g., sterile pyrogen-free water, before use. Sterile injectable solutions are prepared by incorporating the antigen binding molecules of the invention in the required amount in the appropriate solvent with various of the other ingredients enumerated below, as required. Sterility may be readily accomplished, e.g., by filtration through sterile filtration membranes. Generally, dispersions are prepared by incorporating the various sterilized active ingredients into a sterile vehicle which contains the basic dispersion medium and/or the other ingredients. In the case of sterile powders for the preparation of sterile injectable solutions, suspensions or emulsion, the preferred methods of preparation are vacuum-drying or freeze-drying techniques which yield a powder of the active ingredient plus any additional desired ingredient from a previously sterile-filtered liquid medium thereof. The liquid medium should be suitably buffered if necessary and the liquid diluent first rendered isotonic prior to injection with sufficient saline or glucose. The composition must be stable under the conditions of manufacture and storage, and preserved against the contaminating action of microorganisms, such as bacteria and fungi. It will be appreciated that endotoxin contamination should be kept minimally at a safe level, for example, less that 0.5 ng/mg protein. Suitable pharmaceutically acceptable excipients include, but are not limited to: buffers such as phosphate, citrate, and other organic acids; antioxidants including ascorbic acid and methionine; preservatives (such as octadecyldimethylbenzyl ammonium chloride; hexamethonium chloride; benzalkonium chloride; benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g. Zn-protein complexes); and/or non-ionic surfactants such as polyethylene glycol (PEG). Aqueous injection suspensions may contain compounds which increase the viscosity of the suspension, such as sodium carboxymethyl cellulose, sorbitol, dextran, or the like. Optionally, the suspension may also contain suitable stabilizers or agents which increase the solubility of the compounds to allow for the preparation of highly concentrated solutions. Additionally, suspensions of the active compounds may be prepared as appropriate oily injection suspensions. Suitable lipophilic solvents or vehicles include fatty oils such as sesame oil, or synthetic fatty acid esters, such as ethyl cleats or triglycerides, or liposomes.

Active ingredients may be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles and nanocapsules) or in macroemulsions. Such techniques are disclosed in Remington's Pharmaceutical Sciences (18th Ed. Mack Printing Company, 1990). Sustained-release preparations may be prepared. Suitable examples of sustained-release preparations include semipermeable matrices of solid hydrophobic polymers containing the polypeptide, which matrices are in the form of shaped articles, e.g. films, or microcapsules. In particular embodiments, prolonged absorption of an injectable composition can be brought about by the use in the compositions of agents delaying absorption, such as, for example, aluminum monostearate, gelatin or combinations thereof.

Exemplary pharmaceutically acceptable excipients herein further include insterstitial drug dispersion agents such as soluble neutral-active hyaluronidase glycoproteins (sHASEGP), for example, human soluble PH-20 hyaluronidase glycoproteins, such as rHuPH20 (HYLENEX®, Baxter International, Inc.). Certain exemplary sHASEGPs and methods of use, including rHuPH20, are described in US Patent Publication Nos. 2005/0260186 and 2006/0104968. In one aspect, a sHASEGP is combined with one or more additional glycosaminoglycanases such as chondroitinases.

Exemplary lyophilized antibody formulations are described in U.S. Pat. No. 6,267,958. Aqueous antibody formulations include those described in U.S. Pat. No. 6,171,586 and WO2006/044908, the latter formulations including a histidine-acetate buffer.

In addition to the compositions described previously, the antigen binding molecules may also be formulated as a depot preparation. Such long acting formulations may be administered by implantation (for example subcutaneously or intramuscularly) or by intramuscular injection. Thus, for example, the fusion proteins may be formulated with suitable polymeric or hydrophobic materials (for example as emulsion in an acceptable oil) or ion exchange resins, or as sparingly soluble derivatives, for example, as a sparingly soluble salt.

Pharmaceutical compositions comprising the bispecific antigen binding molecules of the invention may be manufactured by means of conventional mixing, dissolving, emulsifying, encapsulating, entrapping or lyophilizing processes. Pharmaceutical compositions may be formulated in conventional manner using one or more physiologically acceptable carriers, diluents, excipients or auxiliaries which facilitate processing of the proteins into preparations that can be used pharmaceutically. Proper formulation is dependent upon the route of administration chosen.

The bispecific antigen binding molecules may be formulated into a composition in a free acid or base, neutral or salt form. Pharmaceutically acceptable salts are salts that substantially retain the biological activity of the free acid or base. These include the acid addition salts, e.g. those formed with the free amino groups of a proteinaceous composition, or which are formed with inorganic acids such as for example, hydrochloric or phosphoric acids, or such organic acids as acetic, oxalic, tartaric or mandelic acid. Salts formed with the free carboxyl groups can also be derived from inorganic bases such as for example, sodium, potassium, ammonium, calcium or ferric hydroxides; or such organic bases as isopropylamine, trimethylamine, histidine or procaine. Pharmaceutical salts tend to be more soluble in aqueous and other protic solvents than are the corresponding free base forms.

The composition herein may also contain more than one active ingredients as necessary for the particular indication being treated, preferably those with complementary activities that do not adversely affect each other. Such active ingredients are suitably present in combination in amounts that are effective for the purpose intended.

The formulations to be used for in vivo administration are generally sterile. Sterility may be readily accomplished, e.g., by filtration through sterile filtration membranes.

Therapeutic Methods and Compositions

Any of the bispecific antigen binding molecules provided herein may be used in therapeutic methods.

For use in therapeutic methods, bispecific antigen binding molecules of the invention can be formulated, dosed, and administered in a fashion consistent with good medical practice. Factors for consideration in this context include the particular disorder being treated, the particular mammal being treated, the clinical condition of the individual patient, the cause of the disorder, the site of delivery of the agent, the method of administration, the scheduling of administration, and other factors known to medical practitioners.

In one aspect, bispecific antigen binding molecules of the invention for use as a medicament are provided.

In further aspects, bispecific antigen binding molecules of the invention for use (i) in stimulating or enhancing T cell response, (ii) for use in supporting survival of activated T cells, (iii) for use in the treatment of infections, (iv) for use in the treatment of cancer, (v) for use in delaying progression of cancer, or (vi) for use in prolonging the survival of a patient suffering from cancer, are provided. In a particular aspect, bispecific antigen binding molecules of the invention for use in treating a disease, in particular for use in the treatment of cancer, are provided.

In certain aspects, bispecific antigen binding molecules of the invention for use in a method of treatment are provided. In one aspect, the invention provides a bispecific antigen binding molecule as described herein for use in the treatment of a disease in an individual in need thereof. In certain aspects, the invention provides a bispecific antigen binding molecule for use in a method of treating an individual having a disease comprising administering to the individual a therapeutically effective amount of the bispecific antigen binding molecule. In certain aspects the disease to be treated is cancer. The subject, patient, or "individual" in need of treatment is typically a mammal, more specifically a human.

In one aspect, provided is a method for (i) stimulating or enhancing T-cell response, (ii) supporting survival of activated T cells, (iii) treating infections, (iv) treating cancer, (v) delaying progression of cancer or (vi) prolonging the survival of a patient suffering from cancer, wherein the method comprises administering a therapeutically effective amount of the bispecific antigen binding molecule of the invention to an individual in need thereof.

In a further aspect, the invention provides for the use of the bispecific antigen binding molecule of the invention in the manufacture or preparation of a medicament for the treatment of a disease in an individual in need thereof. In one aspect, the medicament is for use in a method of treating a disease comprising administering to an individual having the disease a therapeutically effective amount of the medicament. In certain aspects, the disease to be treated is a proliferative disorder, particularly cancer. Examples of cancers include, but are not limited to, bladder cancer, brain cancer, head and neck cancer, pancreatic cancer, lung cancer, breast cancer, ovarian cancer, uterine cancer, cervical cancer, endometrial cancer, esophageal cancer, colon cancer, colorectal cancer, rectal cancer, gastric cancer, prostate cancer, blood cancer, skin cancer, squamous cell carcinoma, bone cancer, and kidney cancer. Other examples of cancer include carcinoma, lymphoma (e.g., Hodgkin's and non-Hodgkin's lymphoma), blastoma, sarcoma, and leukemia. Other cell proliferation disorders that can be treated using the bispecific antigen binding molecule or antibody of the invention include, but are not limited to neoplasms located in the: abdomen, bone, breast, digestive system, liver, pancreas, peritoneum, endocrine glands (adrenal, parathyroid, pituitary, testicles, ovary, thymus, thyroid), eye, head and neck, nervous system (central and peripheral), lymphatic system, pelvic, skin, soft tissue, spleen, thoracic region, and urogenital system. Also included are pre-cancerous conditions or lesions and cancer metastases. In certain embodiments the cancer is chosen from the group consisting of renal cell cancer, skin cancer, lung cancer, colorectal cancer, breast cancer, brain cancer, head and neck cancer. A skilled artisan readily recognizes that in many cases the bispecific antigen binding molecule or antibody of the invention may not provide a cure but may provide a benefit. In some aspects, a physiological change having some benefit is also considered therapeutically beneficial. Thus, in some aspects, an amount of the bispecific antigen binding molecule or antibody of the invention that provides a physiological change is considered an "effective amount" or a "therapeutically effective amount".

For the prevention or treatment of disease, the appropriate dosage of a bispecific antigen binding molecule of the invention (when used alone or in combination with one or more other additional therapeutic agents) will depend on the type of disease to be treated, the route of administration, the body weight of the patient, the specific molecule, the severity and course of the disease, whether the bispecific antigen binding molecule or antibody of the invention is administered for preventive or therapeutic purposes, previous or concurrent therapeutic interventions, the patient's clinical history and response to the fusion protein, and the discretion of the attending physician. The practitioner responsible for administration will, in any event, determine the concentration of active ingredient(s) in a composition and appropriate dose(s) for the individual subject. Various dosing schedules including but not limited to single or multiple administrations over various time-points, bolus administration, and pulse infusion are contemplated herein.

The bispecific antigen binding molecule of the invention is suitably administered to the patient at one time or over a series of treatments. Depending on the type and severity of the disease, about 1 µg/kg to 15 mg/kg (e.g. 0.1 mg/kg-10 mg/kg) of TNF family ligand trimer-containing antigen binding molecule can be an initial candidate dosage for administration to the patient, whether, for example, by one or more separate administrations, or by continuous infusion. One typical daily dosage might range from about 1 µg/kg to 100 mg/kg or more, depending on the factors mentioned above. For repeated administrations over several days or longer, depending on the condition, the treatment would generally be sustained until a desired suppression of disease symptoms occurs. One exemplary dosage of the bispecific antigen binding molecule or antibody of the invention would be in the range from about 0.005 mg/kg to about 10 mg/kg. In other examples, a dose may also comprise from about 1 µg/kg body weight, about 5 µg/kg body weight, about 10 µg/kg body weight, about 50 µg/kg body weight, about 100 µg/kg body weight, about 200 µg/kg body weight, about 350 µg/kg body weight, about 500 µg/kg body weight, about 1 mg/kg body weight, about 5 mg/kg body weight, about 10 mg/kg body weight, about 50 mg/kg body weight, about 100 mg/kg body weight, about 200 mg/kg body weight, about 350 mg/kg body weight, about 500 mg/kg body weight, to about 1000 mg/kg body weight or more per administration, and any range derivable therein. In examples of a derivable range from the numbers listed herein, a range of about 0.1 mg/kg body weight to about 20 mg/kg body weight, about 5 µg/kg body weight to about 1 mg/kg body weight etc., can be administered, based on the numbers described above. Thus, one or more doses of about 0.5 mg/kg, 2.0 mg/kg, 5.0 mg/kg or 10 mg/kg (or any combination thereof) may be administered to the patient. Such doses may be administered intermittently, e.g. every week or every three weeks (e.g.

such that the patient receives from about two to about twenty, or e.g. about six doses of the fusion protein). In a particular aspect, the bispecific antigen binding molecule will be administered every three weeks. An initial higher loading dose, followed by one or more lower doses may be administered. However, other dosage regimens may be useful. The progress of this therapy is easily monitored by conventional techniques and assays.

The bispecific antigen binding molecule of the invention will generally be used in an amount effective to achieve the intended purpose. For use to treat or prevent a disease condition, the bispecific antigen binding molecule or antibody of the invention, or pharmaceutical compositions thereof, are administered or applied in a therapeutically effective amount. Determination of a therapeutically effective amount is well within the capabilities of those skilled in the art, especially in light of the detailed disclosure provided herein.

For systemic administration, a therapeutically effective dose can be estimated initially from in vitro assays, such as cell culture assays. A dose can then be formulated in animal models to achieve a circulating concentration range that includes the $IC_{50}$ as determined in cell culture. Such information can be used to more accurately determine useful doses in humans.

Initial dosages can also be estimated from in vivo data, e.g., animal models, using techniques that are well known in the art. One having ordinary skill in the art could readily optimize administration to humans based on animal data.

Dosage amount and interval may be adjusted individually to provide plasma levels of the the bispecific antigen binding molecule or antibody of the invention which are sufficient to maintain therapeutic effect. Usual patient dosages for administration by injection range from about 0.1 to 50 mg/kg/day, typically from about 0.1 to 1 mg/kg/day. Therapeutically effective plasma levels may be achieved by administering multiple doses each day. Levels in plasma may be measured, for example, by HPLC.

In cases of local administration or selective uptake, the effective local concentration of the bispecific antigen binding molecule or antibody of the invention may not be related to plasma concentration. One skilled in the art will be able to optimize therapeutically effective local dosages without undue experimentation.

A therapeutically effective dose of the bispecific antigen binding molecule of the invention described herein will generally provide therapeutic benefit without causing substantial toxicity. Toxicity and therapeutic efficacy of a fusion protein can be determined by standard pharmaceutical procedures in cell culture or experimental animals. Cell culture assays and animal studies can be used to determine the $LD_{50}$ (the dose lethal to 50% of a population) and the $ED_{50}$ (the dose therapeutically effective in 50% of a population). The dose ratio between toxic and therapeutic effects is the therapeutic index, which can be expressed as the ratio $LD_{50}/ED_{50}$. Bispecific antigen binding molecules that exhibit large therapeutic indices are preferred. In one aspect, the bispecific antigen binding molecule or antibody of the invention exhibits a high therapeutic index. The data obtained from cell culture assays and animal studies can be used in formulating a range of dosages suitable for use in humans. The dosage lies preferably within a range of circulating concentrations that include the ED50 with little or no toxicity. The dosage may vary within this range depending upon a variety of factors, e.g., the dosage form employed, the route of administration utilized, the condition of the subject, and the like. The exact formulation, route of administration and dosage can be chosen by the individual physician in view of the patient's condition (see, e.g., Fingl et al., 1975, in: The Pharmacological Basis of Therapeutics, Ch. 1, p. 1, incorporated herein by reference in its entirety).

The attending physician for patients treated with bispecific antibodies of the invention would know how and when to terminate, interrupt, or adjust administration due to toxicity, organ dysfunction, and the like. Conversely, the attending physician would also know to adjust treatment to higher levels if the clinical response were not adequate (precluding toxicity). The magnitude of an administered dose in the management of the disorder of interest will vary with the severity of the condition to be treated, with the route of administration, and the like. The severity of the condition may, for example, be evaluated, in part, by standard prognostic evaluation methods. Further, the dose and perhaps dose frequency will also vary according to the age, body weight, and response of the individual patient.

Other Agents and Treatments

The bispecific antigen binding molecule of the invention may be administered either alone or in combination with one or more other agents in therapy. For instance, the bispecific antigen binding molecule or antibody of the invention of the invention may be co-administered with at least one additional therapeutic agent. The term "therapeutic agent" encompasses any agent that can be administered for treating a symptom or disease in an individual in need of such treatment. Such additional therapeutic agent may comprise any active ingredients suitable for the particular indication being treated, preferably those with complementary activities that do not adversely affect each other. In certain embodiments, an additional therapeutic agent is another anti-cancer agent or chemotherapeutic agent, for example a microtubule disruptor, an antimetabolite, a topoisomerase inhibitor, a DNA intercalator, an alkylating agent, an anthracycline, a hormonal therapy, a kinase inhibitor, a receptor antagonist, an activator of tumor cell apoptosis, or an antiangiogenic agent. In certain aspects, an additional therapeutic agent is an immunomodulatory agent, a cytostatic agent, an inhibitor of cell adhesion, a cytotoxic or cytostatic agent, an activator of cell apoptosis, or an agent that increases the sensitivity of cells to apoptotic inducers.

In one aspect, the bispecific antigen binding molecule of the invention is administered in combination with a chemotherapeutic agent, radiation therapy and/or other agents for use in cancer immunotherapy. A chemotherapeutic agent is an anti-cancer agent as defined above. Alternatively, a chemotherapeutic agent is selected from the group consisting of nucleotide analogs (e.g. azacitidine, capecitabine, doxifluridine, fluorouracil, gemcitabine, hydroxyurea or methotrexate), platinum-based agents (e.g. carboplatin, cisplatin or oxaliplatin), taxanes (e.g. paclitaxel, docetaxel, abraxane or taxotere), alkylating agents (e.g. cyclophosphamide, chlorambucil, dacarbazine or temozolomide), anthracyclines (e.g. doxorubicin or idarubicin), topoisomerase I inhibitors (e.g. irinotecan or topotecan), topoisomerase II inhibitors (e.g. etoposide or teniposide), kinase inhibitors (e.g. erlotinib, imatinib, vemurafenib or vismodegib), retinoids, histone deacetylase inhibitors and vinca alkaloids. Other agents for use in cancer immunotherapy include for example agents blocking PD-L1/PD-1 interaction such as a PD1 antibody (e.g. pembrolizumab or nivolumab) or a PD-L1 antibody (e.g. atezolizumab). Bispecific antigen binding molecules of the invention may also be used in combination with radiation therapy.

Such other agents are suitably present in combination in amounts that are effective for the purpose intended. The effective amount of such other agents depends on the amount of fusion protein used, the type of disorder or treatment, and other factors discussed above. The bispecific antigen binding molecule or antibody of the invention are generally used in the same dosages and with administration routes as described herein, or about from 1 to 99% of the dosages described herein, or in any dosage and by any route that is empirically/clinically determined to be appropriate.

Such combination therapies noted above encompass combined administration (where two or more therapeutic agents are included in the same or separate compositions), and separate administration, in which case, administration of the bispecific antigen binding molecule or antibody of the invention can occur prior to, simultaneously, and/or following, administration of the additional therapeutic agent and/or adjuvant. In one aspect, administration of the bispecific antigen binding molecule and administration of an additional therapeutic agent occur within about one month, or within about one, two or three weeks, or within about one, two, three, four, five, or six days, of each other.

Articles of Manufacture

In another aspect of the invention, an article of manufacture containing materials useful for the treatment, prevention and/or diagnosis of the disorders described above is provided. The article of manufacture comprises a container and a label or package insert on or associated with the container. Suitable containers include, for example, bottles, vials, syringes, IV solution bags, etc. The containers may be formed from a variety of materials such as glass or plastic. The container holds a composition which is by itself or combined with another composition effective for treating, preventing and/or diagnosing the condition and may have a sterile access port (for example the container may be an intravenous solution bag or a vial having a stopper that is pierceable by a hypodermic injection needle). At least one active agent in the composition is a bispecific antigen binding molecule of the invention.

The label or package insert indicates that the composition is used for treating the condition of choice. Moreover, the article of manufacture may comprise (a) a first container with a composition contained therein, wherein the composition comprises a bispecific antigen binding molecule of the invention; and (b) a second container with a composition contained therein, wherein the composition comprises a further cytotoxic or otherwise therapeutic agent. The article of manufacture in this embodiment of the invention may further comprise a package insert indicating that the compositions can be used to treat a particular condition.

Alternatively, or additionally, the article of manufacture may further comprise a second (or third) container comprising a pharmaceutically-acceptable buffer, such as bacteriostatic water for injection (BWFI), phosphate-buffered saline, Ringer's solution and dextrose solution. It may further include other materials desirable from a commercial and user standpoint, including other buffers, diluents, filters, needles, and syringes.

TABLE C (Sequences):

| SEQ ID NO: | Name | Sequence |
|---|---|---|
| 1 | 4-1BB (20H4.9) CDR-H1 | GYYWS |
| 2 | 4-1BB (20H4.9) CDR-H2 | EINHGGYVTYNPSLES |
| 3 | 4-1BB (20H4.9) CDR-H3 | DYGPGNYDWYFDL |
| 4 | 4-1BB (20114.9) CDR-L1 | RASQSVSSYLA |
| 5 | 4-1BB (20H4.9) CDR-L2 | DASNRAT |
| 6 | 4-1BB (20114.9) CDR-L3 | QQRSNWPPALT |
| 7 | 4-1BB (2(1114.9) VH | QVQLQQWGAGLLKPSETLSLTCAVYGGSFSGY YWSWIRQSPEKGLEWIGEINHGGYVTYNPSLES RVTISVDTSKNQFSLKLSSVTAADTAVYYCAR DYGPGNYDWYFDLWGRGTLVTVSS |
| 8 | 4-1BB (20H4.9) VL | EIVLTQSPATLSLSPGERATLSCRASQSVSSYLA WYQQKPGQAPRLLIYDASNRATGIPARFSGSGS GTDFTLTISSLEPEDFAVYYCQQRSNWPPALTF GGGTKVEIK |
| 9 | FAP (28H1) CDR-H1 | SHAMS |
| 10 | FAP (28H1) CDR-H2 | AIWASGEQYYADSVKG |
| 11 | FAP (28H1) CDR-H3 | GWLGNFDY |
| 12 | FAP (28H1) CDR-L1 | RASQSVSRSYLA |
| 13 | FAP (28H1) CDR-L2 | GASTRAT |
| 14 | FAP (28H1) CDR-L3 | QQGQVIPPT |
| 15 | FAP (4B9) CDR-H1 | SYAMS |
| 16 | FAP (4B9) CDR-H2 | AIIGSGASTYYADSVKG |
| 17 | FAP (4B9) CDR-H3 | GWFGGFNY |

TABLE C-continued

(Sequences):

| SEQ ID NO: | Name | Sequence |
|---|---|---|
| 18 | FAP (4B9) CDR-L1 | RASQSVTSSYLA |
| 19 | FAP (4B9) CDR-L2 | VGSRRAT |
| 20 | FAP (4B9) CDR-L3 | QQGIMLPPT |
| 21 | FAP (28H1) VH | EVQLLESGGGLVQPGGSLRLSCAASGFTFSSHA MSWVRQAPGKGLEWVSAIWASGEQYYADSV KGRFTISRDNSKNTLYLQMNSLRAEDTAVYYC AKGWLGNFDYWGQGTLVTVSS |
| 22 | FAP (28H1) VL | EIVLTQSPGTLSLSPGERATLSCRASQSVSRSYL AWYQQKPGQAPRLLIIGASTRATGIPDRFSGSG SGTDFTLTISRLEPEDFAVYYCQQGQVIPPTFGQ GTKVEIK |
| 23 | FAP (4B9) VH | EVQLLESGGGLVQPGGSLRLSCAASGFTFSSYA MSWVRQAPGKGLEWVSAIIGSGASTYYADSVK GRFTISRDNSKNTLYLQMNSLRAEDTAVYYCA KGWFGGFNYWGQGTLVTVSS |
| 24 | FAP (4B9) VL | EIVLTQSPGTLSLSPGERATLSCRASQSVTSSYL AWYQQKPGQAPRLLINVGSRRATGIPDRFSGSG SGTDFTLTISRLEPEDFAVYYCQQGIMLPPTFGQ GTKVEIK |
| 25 | CEA (T84.66-LCHA)-CDR-H1 | DTYMH |
| 26 | CEA (T84.66-LCHA)-CDR-H2 | RIDPANGNSKYVPKFQG |
| 27 | CEA (T84.66-LCHA)-CDR-H3 | FGYYVSDYAMAY |
| 28 | CEA (T84.66-LCHA)-CDR-L1 | RAGESVDIFGVGFLH |
| 29 | CEA (T84.66-LCHA)-CDR-L2 | RASNRAT |
| 30 | CEA (T84.66-LCHA)-CDR-L3 | QQTNEDPYT |
| 31 | CEA (T84.66-LCHA) VH | QVQLVQSGAEVKKPGSSVKVSCKASGFNIKDT YMHWVRQAPGQGLEWMGRIDPANGNSKYVP KFQGRVTITADTSTSTAYMELSSLRSEDTAVYY CAPFGYYVSDYAMAYWGQGTLVTVSS |
| 32 | CEA (T84.66-LCHA) VL | EIVLTQSPATLSLSPGERATLSCRAGESVDIFGV GFLHWYQQKPGQAPRLLIYRASNRATGIPARFS GSGSGTDFTLTISSLEPEDFAVYYCQQTNEDPY TFGQGTKLEIK |
| 33 | CEA (A5B7)- CDR-H1 | SYWMH |
| 34 | CEA (A5B7)- CDR-H2 | FIRNKANGGTTEYAAS |
| 35 | CEA (A5B7)- CDR-H3 | DRGLRFYFDY |
| 36 | CEA (A5B7)- CDR-L1 | TLRRGINVGAYSIY |
| 37 | CEA (A5B7)- CDR-L2 | YKSDSDKQQGS |
| 38 | CEA (A5B7)- CDR-L3 | MIWHSGASAV |
| 39 | CEA (A5B7) VH | EVQLVESGGGLVQPGRSLRLSCAASGFTVSSY WMHWVRQAPGKGLEWVGFIRNKANGGTTEY AASVKGRFTISRDDSKNTLYLQMNSLRAEDTA VYYCARDRGLRFYFDYWGQGTTVTVSS |

TABLE C-continued (Sequences):

| SEQ ID NO: | Name | Sequence |
|---|---|---|
| 40 | CEA (A5B7) VL | QAVLTQPASLSASPGASASLTCTLRRGINVGAY SIYWYQQKPGSPPQYLLRYKSDSDKQQGSGVS SRFSASKDASANAGILLISGLQSEDEADYYCMI WHSGASAVFGGGTKLTVL |
| 41 | VHCH1 (20H4.9)-Heavy chain hole-VL (4B9) (nucleotide sequence) | see Table 1 |
| 42 | VHCH1 (20H4.9)-Heavy chain knob-VH (4B9) (nucleotide sequence) | see Table 1 |
| 43 | VLCL-Light chain (20H4.9) (nucleotide sequence) | see Table 1 |
| 44 | VHCH1 (20H4.9)-Heavy chain hole-VL (4B9) | see Table 1 |
| 45 | VHCH1 (20H4.9)-Heavy chain knob-VH (4B9) | see Table 1 |
| 46 | VLCL-Light chain (20H4.9) | see Table 1 |
| 47 | VHCH1 (20H4.9)-Heavy chain hole-VH (4B9) (nucleotide sequence) | see Table 2 |
| 48 | VHCH1 (20H4.9)-Heavy chain knob-VL (4B9) (nucleotide sequence) | see Table 2 |
| 49 | VHCH1 (20H4.9)-Heavy chain hole-VH (4B9) | see Table 2 |
| 50 | VHCH1 (20H4.9)-Heavy chain knob-VL (4B9) | see Table 2 |
| 51 | Nucleotide sequence Fc hole chain | see Table 4 |
| 52 | Nucleotide sequence human 4-1BB antigen Fc knob chain | see Table 4 |
| 53 | Fc hole chain | see Table 4 |
| 54 | human 4-1BB antigen Fc knob chain | see Table 4 |
| 55 | VHCH1-VHCH1 (20H4.9)- Heavy chain hole-VL(4B9) (nucleotide sequence) | see Table 6 |
| 56 | VHCH1-VHCH1 (20H4.9)- Heavy chain knob-VH(4B9) (nucleotide sequence) | see Table 6 |
| 57 | VHCH1-VHCH1 (20H4.9)- Heavy chain hole-VL (4B9) | see Table 6 |
| 58 | VHCH1-VHCH1 (20H4.9)- Heavy chain knob-VH (4B9) | see Table 6 |
| 59 | VHCH1-VHCH1 (20H4.9)- Heavy chain hole-VH (4B9) (nucleotide sequence) | see Table 7 |
| 60 | VHCH1-VHCH1 (20H4.9)- Heavy chain knob-VL (4B9) (nucleotide sequence) | see Table 7 |

TABLE C-continued (Sequences):

| SEQ ID NO: | Name | Sequence |
|---|---|---|
| 61 | VHCH1-VHCH1 (20H4.9)-Heavy chain hole-VH (4B9) | see Table 7 |
| 62 | VHCH1-VHCH1 (20H4.9)-Heavy chain knob-VL (4B9) | see Table 7 |
| 63 | VHCH1 (20H4.9)-Heavy chain hole-VL (T84.66-LCHA) (nucleotide sequence) | see Table 22 |
| 64 | VHCH1 (20H4.9)-Heavy chain knob-VH (T84.66-LCHA) (nucleotide sequence) | see Table 22 |
| 65 | VHCH1 (20H4.9)-Heavy chain hole-VL (T84.66-LCHA) | see Table 22 |
| 66 | VHCH1 (20H4.9)-Heavy chain knob-VH (T84.66-LCHA) | see Table 22 |
| 67 | VHCH1 (20H4.9)-Heavy chain hole-VH (T84.66-LCHA) (nucleotide sequence) | see Table 23 |
| 68 | VHCH1 (20H4.9)-Heavy chain knob-VL (T84.66-LCHA) (nucleotide sequence) | see Table 23 |
| 69 | VHCH1 (20H4.9)-Heavy chain hole-VH (T84.66-LCHA) | see Table 23 |
| 70 | VHCH1 (20H4.9)-Heavy chain knob-VL (T84.66-LCHA) | see Table 23 |
| 71 | VHCH1 (20H4.9)-Heavy chain hole-VL (A5B7) (nucleotide sequence) | see Table 24 |
| 72 | VHCH1 (20H4.9)-Heavy chain knob-VH (A5B7) (nucleotide sequence) | see Table 24 |
| 73 | VHCH1 (20H4.9)-Heavy chain hole-VL (A5B7) | see Table 24 |
| 74 | VHCH1 (20H4.9)-Heavy chain knob-VH (A5B7) | see Table 24 |
| 75 | VHCH1 (20H4.9)-Heavy chain hole-VH (A5B7) (nucleotide sequence) | see Table 25 |
| 76 | VHCH1 (20H4.9)-Heavy chain knob-VL (A5B7) (nucleotide sequence) | see Table 25 |
| 77 | VHCH1 (20H4.9)-Heavy chain hole-VH (A5B7) | see Table 25 |
| 78 | VHCH1 (20H4.9)-Heavy chain knob-VL (A5B7) | see Table 25 |
| 79 | VHCH1-VHCH1 (20H4.9)-Heavy chain hole-VL(T84.66-LCHA) (nucleotide sequence) | see Table 40 |

TABLE C-continued (Sequences):

| SEQ ID NO: | Name | Sequence |
|---|---|---|
| 80 | VHCH1-VHCH1 (20H4.9)-Heavy chain knob-VH(T84.66-LCHA) (nucleotide sequence) | see Table 40 |
| 81 | VHCH1-VHCH1 (20H4.9)-Heavy chain hole-VL (T84.66-LCHA) | see Table 40 |
| 82 | VHCH1-VHCH1 (20H4.9)-Heavy chain knob-VH (T84.66-LCHA) | see Table 40 |
| 83 | VHCH1-VHCH1 (20H4.9)-Heavy chain hole-VH (T84.66-LCHA) (nucleotide sequence) | see Table 41 |
| 84 | VHCH1-VHCH1 (20H4.9)-Heavy chain knob-VL (T84.66-LCHA) (nucleotide sequence) | see Table 41 |
| 85 | VHCH1-VHCH1 (20H4.9)-Heavy chain hole-VH (T84.66-LCHA) | see Table 41 |
| 86 | VHCH1-VHCH1 (20H4.9)-Heavy chain knob-VL (T84.66-LCHA) | see Table 41 |
| 87 | VHCH1-VHCH1 (20H4.9)-Heavy chain hole-VL(A5B7) (nucleotide sequence) | see Table 42 |
| 88 | VHCH1-VHCH1 (20H4.9)-Heavy chain knob-VH(A5B7)(nucleotide sequence) | see Table 42 |
| 89 | VHCH1-VHCH1 (20H4.9)-Heavy chain hole-VL (A5B7) | see Table 42 |
| 90 | VHCH1-VHCH1 (20H4.9)-Heavy chain knob-VH (A5B7) | see Table 42 |
| 91 | VHCH1-VHCH1 (20H4.9)-Heavy chain hole-VH (A5B7)(nucleotide sequence) | see Table 43 |
| 92 | VHCH1-VHCH1 (20H4.9)-Heavy chain knob-VL (A5B7)(nucleotide sequence) | see Table 43 |
| 93 | VHCH1-VHCH1 (20H4.9)-Heavy chain hole-VH (A5B7) | see Table 43 |
| 94 | VHCH1-VHCH1 (20H4.9)-Heavy chain knob-VL (A5B7) | see Table 43 |
| 95 | Human (hu) FAP | UniProt no. Q12884 |
| 96 | hu FAP ectodomain + poly-lys-tag + his$_6$-tag | RPSRVHNSEENTMRALTLKDILNGTFSYKTFFP NWISGQEYLHQSADNNIVLYNIETGQSYTILSN RTMKSVNASNYGLSPDRQFVYLESDYSKLWR YSYTATYYIYDLSNGEFVRGNELPRPIQYLCWS PVGSKLAYVYQNNIYLKQRPGDPPFQITFNGRE |

TABLE C-continued (Sequences):

| SEQ ID NO: | Name | Sequence |
|---|---|---|
| | | NKIFNGIPDWVYEEEMLATKYALWWSPNGKFL AYAEFNDTDIPVIAYSYYGDEQYPRTINIPYPKA GAKNPVVRIFIIDTTYPAYVGPQEVPVPAMIASS DYYFSWLTWVTDERVCLQWLKRVQNVSVLSI CDFREDWQTWDCPKTQEHIEESRTGWAGGFFV STPVFSYDAISYYKIFSDKDGYKHIHYIKDTVEN AIQITSGKWEAINIFRVTQDSLFYSSNEFEEYPG RRNIYRISIGSYPPSKKCVTCHLRKERCQYYTAS FSDYAKYYALVCYGPGIPISTLHDGRTDQEIKIL EENKELENALKNIQLPKEEIKKLEVDEITLWYK MILPPQFDRSKKYPLLIQVYGGPCSQSVRSVFA VNWISYLASKEGMVIALVDGRGTAFQGDKLLY AVYRKLGVYEVEDQITAVRKFIEMGFIDEKRIA IWGWSYGGYVSSLALASGTGLFKCGIAVAPVS SWEYYASVYTERFMGLPTKDDNLEHYKNSTV MARAEYFRNVDYLLIHGTADDNVHFQNSAQIA KALVNAQVDFQAMWYSDQNHGLSGLSTNHLY THMTHFLKQCFSLSDGKKKKKGHHHHHH |
| 97 | mouse FAP | UniProt no. P97321 |
| 98 | Murine FAP ectodomain + poly-lys-tag + his6-tag | RPSRVYKPEGNTKRALTLKDILNGTFSYKTYFP NWISEQEYLHQSEDDNIVFYNIETRESYIILSNST MKSVNATDYGLSPDRQFVYLESDYSKLWRYS YTATYYIYDLQNGEFVRGYELPRPIQYLCWSPV GSKLAYVYQNNIYLKQRPGDPPFQITYTGRENR IFNGIPDWVYEEEMLATKYALWWSPDGKFLAY VEFNDSDIPIIAYSYYGDGQYPRTINIPYPKAGA KNPVVRVFIVDTTYPHHVGPMEVPVPEMIASSD YYFSWLTWVSSERVCLQWLKRVQNVSVLSICD FREDWHAWECPKNQEHVEESRTGWAGGFFVS TPAFSQDATSYYKIFSDKDGYKHIHYIKDTVEN AIQITSGKWEAIYIFRVTQDSLFYSSNEFEGYPG RRNIYRISIGNSPPSKKCVTCHLRKERCQYYTAS FSYKAKYYALVCYGPGLPISTLHDGRTDQEIQV LEENKELENSLRNIQLPKVEIKKLKDGGLTFWY KMILPPQFDRSKKYPLLIQVYGGPCSQSVKSVF AVNWITYLASKEGIVIALVDGRGTAFQGDKFL HAVYRKLGVYEVEDQLTAVRKFIEMGFIDEERI AIWGWSYGGYVSSLALASGTGLFKCGIAVAPV SSWEYYASIYSERFMGLPTKDDNLEHYKNSTV MARAEYFRNVDYLLIHGTADDNVHFQNSAQIA KALVNAQVDFQAMWYSDQNHGILSGRSQNHL YTHMTHFLKQCFSLSDGKKKKKGHHHHHH |
| 99 | Cynomolgus FAP ectodomain + poly-lys-tag + his6-tag | RPPRVHNSEENTMRALTLKDILNGTFSYKTFFP NWISGQEYLHQSADNNIVLYNIETGQSYTILSN RTMKSVNASNYGLSPDRQFVYLESDYSKLWR YSYTATYYIYDLSNGEFVRGNELPRPIQYLCWS PVGSKLAYVYQNNIYLKQRPGDPPFQITFNGRE NKIFNGIPDWVYEEEMLATKYALWWSPNGKFL AYAEFNDTDIPVIAYSYYGDEQYPRTINIPYPKA GAKNPFVRIFIIDTTYPAYVGPQEVPVPAMIASS DYYFSWLTWVTDERVCLQWLKRVQNVSVLSI CDFREDWQTWDCPKTQEHIEESRTGWAGGFFV STPVFSYDAISYYKIFSDKDGYKHIHYIKDTVEN AIQITSGKWEAINIFRVTQDSLFYSSNEFEDYPG RRNIYRISIGSYPPSKKCVTCHLRKERCQYYTAS FSDYAKYYALVCYGPGIPISTLHDGRTDQEIKIL EENKELENALKNIQLPKEEIKKLEVDEITLWYK MILPPQFDRSKKYPLLIQVYGGPCSQSVRSVFA VNWISYLASKEGMVIALVDGRGTAFQGDKLLY AVYRKLGVYEVEDQITAVRKFIEMGFIDEKRIA IWGWSYGGYVSSLALASGTGLFKCGIAVAPVS SWEYYASVYTERFMGLPTKDDNLEHYKNSTV MARAEYFRNVDYLLIHGTADDNVHFQNSAQIA KALVNAQVDFQAMWYSDQNHGLSGLSTNHLY THMTHFLKQCFSLSDGKKKKKGHHHHHH |
| 100 | human CEA | UniProt no. P06731 |
| 101 | human MCSP | UniProt no. Q6UVK1 |
| 102 | human EGFR | UniProt no. P00533 |

TABLE C-continued (Sequences):

| SEQ ID NO: | Name | Sequence |
|---|---|---|
| 103 | human CD19 | UniProt no. P15391 |
| 104 | human CD20 | Uniprot no. P11836 |
| 105 | human CD33 | UniProt no. P20138 |
| 106 | human 4-1BB | UniProt no. Q07011 |
| 107 | murine 4-1BB | UniProt no. P20334 |
| 108 | cynomolgus 4-1BB | Uniprot no. F6W5G6 |
| 109 | Peptide linker (G4S) | GGGGS |
| 110 | Peptide linker (G4S)$_2$ | GGGGSGGGGS |
| 111 | Peptide linker (SG4)$_2$ | SGGGGSGGGG |
| 112 | Peptide linker G4(SG4)$_2$ | GGGGSGGGGSGGGG |
| 113 | peptide linker | GSPGSSSSGS |
| 114 | (G4S)$_3$ peptide linker | GGGGSGGGGSGGGGS |
| 115 | (G4S)$_4$ peptide linker | GGGGSGGGGSGGGGSGGGGS |
| 116 | peptide linker | GSGSGSGS |
| 117 | peptide linker | GSGSGNGS |
| 118 | peptide linker | GGSGSGSG |
| 119 | peptide linker | GGSGSG |
| 120 | peptide linker | GGSG |
| 121 | peptide linker | GGSGNGSG |
| 122 | peptide linker | GGNGSGSG |
| 123 | peptide linker | GGNGSG |
| 124 | VHCH1(EE) 4-1BB(20H4.9)-Heavy chain knob | see Table 14 |
| 125 | VLCH1 FAP (4B9)-Heavy chain hole | see Table 14 |
| 126 | VLCL(RK)-Light chain 4-1BB (20H4.9) | see Table 14 |
| 127 | VHCL-Light chain FAP(4B9) | see Table 14 |
| 128 | VHCH1 (20H4.9)-Heavy chain hole-VL (DP47) | see Table 17 |
| 129 | VHCH1 (20H4.9)-Heavy chain knob-VH (DP47) | see Table 17 |
| 130 | VHCH1 (20H4.9)-Heavy chain hole-VH (DP47) | see Table 18 |
| 131 | VHCH1 (20H4.9)-Heavy chain knob-VL (DP47) | see Table 18 |
| 132 | VHCH1 (MU137-1)-Heavy chain hole-VL (28H1) | see Table 19 |
| 133 | VHCH1 (MU137-1)-Heavy chain knob-VH (28H1) | see Table 19 |
| 134 | VLCL-Light chain (MU137-1) | see Table 19 |

TABLE C-continued (Sequences):

| SEQ ID NO: | Name | Sequence |
|---|---|---|
| 135 | VHCH1 (MU137-1)-Heavy chain Fc-DD-VH (28H1) | see Table 20 |
| 136 | VHCH1 (MU137-1)-Heavy chain Fc-KK-VL (28H1) | see Table 20 |
| 137 | VHCH1 (20H4.9)-Heavy chain hole-VL (A5B7) (G4S)2 | see Table 26 |
| 138 | VHCH1 (20H4.9)-Heavy chain hole-VH (A5B7) (G4S)2 | see Table 27 |
| 139 | VHCH1 (20H4.9)-Heavy chain hole-VL (2B11) | see Table 48 |
| 140 | VHCH1 (20H4.9)-Heavy chain knob-VH (2B11) | see Table 48 |
| 141 | VHCH1 (20H4.9)-Heavy chain hole-VH (2B11) | see Table 49 |
| 142 | VHCH1 (20H4.9)-Heavy chain knob-VL (2B11) | see Table 49 |
| 143 | VHCH1 (20H4.9)-Heavy chain hole-VL (8B8-018) | see Table 50 |
| 144 | VHCH1 (20H4.9)-Heavy chain knob-VH (8B8-018) | see Table 50 |
| 145 | VHCH1 (20H4.9)-Heavy chain hole-VH (8B8-018) | see Table 51 |
| 146 | VHCH1 (20H4.9)-Heavy chain knob-VL (8B8-018) | see Table 51 |
| 147 | VHCH1-VHCH1 (20H4.9)-Heavy chain Fc hole-VL (2B11) | see Table 53 |
| 148 | VHCH1-VHCH1 (20H4.9)-Heavy chain Fc knob-VH (2B11) | see Table 53 |
| 149 | VHCH1-VHCH1 (20H4.9)-Heavy chain hole-VH (2B11) | see Table 54 |
| 150 | VHCH1-VHCH1 (20H4.9)-Heavy chain knob-VL (2B11) | see Table 54 |
| 151 | VHCH1-VHCH1 (20H4.9)-Heavy chain Fc hole-VL (8B8-018) | see Table 55 |
| 152 | VHCH1-VHCH1 (20H4.9)-Heavy chain Fc knob-VH (8B8-018) | see Table 55 |
| 153 | VHCH1-VHCH1 (20H4.9)-Heavy chain hole-VH (8B8-018) | see Table 56 |
| 154 | VHCH1-VHCH1 (20H4.9)-Heavy chain knob-VL (8B8-018) | see Table 56 |
| 155 | CD19 (8B8-2B11) CDR-H1 | DYIMH |
| 156 | CD19 (8B8-2B11) CDR-H2 | YINPYNDGSKYTEKFQG |
| 157 | CD19 (8B8-2B11) CDR-H3 | GTYYYGPQLFDY |

TABLE C-continued (Sequences):

| SEQ ID NO: | Name | Sequence |
|---|---|---|
| 158 | CD19 (8B8-2B11) CDR-L1 | KSSQSLETSTGTTYLN |
| 159 | CD19 (8B8-2B11) CDR-L2 | RVSKRFS |
| 160 | CD19 (8B8-2B11) CDR-L3 | LQLLEDPYT |
| 161 | CD19 (8B8-2B11) VH | QVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGPQLFDYWGQGTTVTVSS |
| 162 | CD19 (8B8-2B11) VL | DIVMTQTPLSLSVTPGQPASISCKSSQSLETSTGTTYLNWYLQKPGQSPQLLIYRVSKRFSGVPDRFSGSGSGTDFTLKISRVEAEDVGVYYCLQLLEDPYTFGQGTKLEIK |
| 163 | CD19 (8B8-018) CDR-H1 | DYIMH |
| 164 | CD19 (8B8-018) CDR-H2 | YINPYNDGSKYTEKFQG |
| 165 | CD19 (8B8-018) CDR-H3 | GTYYYGSALFDY |
| 166 | CD19 (8B8-018) CDR-L1 | KSSQSLENPNGNTYLN |
| 167 | CD19 (8B8-018) CDR-L2 | RVSKRFS |
| 168 | CD19 | (8B8-018) CDR-L3 LQLTHVPYT |
| 169 | CD19 (8B8-018) VH | QVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGSALFDYWGQGTTVTVSS |
| 170 | CD19 (8B8-018) VL | DIVMTQTPLSLSVTPGQPASISCKSSQSLENPNGNTYLNWYLQKPGQSPQLLIYRVSKRFSGVPDRFSGSGSGTDFTLKISRVEAEDVGVYYCLQLTHVPYTFGQGTKLEIK |
| 171 | 4-1BB (MU137-1) CDR-H1 | YFDMA |
| 172 | 4-1BB (MU137-1) CDR-H2 | SISPSGDIPYYRDSVKG |
| 173 | 4-1BB (MU137-1) CDR-H3 | RSYGGYSELDY |
| 174 | 4-1BB (MU137-1) CDR-L1 | QASQDIGNWLA |
| 175 | 4-1BB (MU137-1) CDR-L2 | GTSSLAD |
| 176 | 4-1BB (MU137-1) CDR-L3 | LQAYGAPWT |
| 177 | 4-1BB (MU137-1) VH | DVQLVESGGGLVQPGRSLKLSCAASGFIFSYFDMAWVRQAPTKGLEWVASISPSGDIPYYRDSVKGRFTVSRENAKSSLYLQMDSLRSEDTATYYCARRSYGGYSELDYWGQGVMVTVSS |
| 178 | 4-1BB (MU137-1) VL | DIQMTQSPASLSASLEEIVTITCQASQDIGNWLAWYHQKPGKSPQLLIYGTSSLADGVPSRFSGSSSGSQYSLKISRLQVEDIGIYYCLQAYGAPWTFGGGTKLELK |
| 179 | CEA (A5B7P)-CDR-H1 | DYYMN |
| 180 | CEA (A5B7P)-CDR-H2 | FIGNKANGYTTEYSASVKG |
| 181 | CEA (A5B7P)-CDR-H3 | DRGLRFYFDY |
| 182 | CEA (A5B7P)-CDR-L1 | RASSSVTYIH |
| 183 | CEA (A5B7P)-CDR-L2 | ATSNLAS |
| 184 | CEA (A5B7P)-CDR-L3 | QHWSSKPPT |

TABLE C-continued (Sequences):

| SEQ ID NO: | Name | Sequence |
|---|---|---|
| 185 | CEA (A5B7P) VH | EVKLVESGGGLVQPGGSLRLSCATSGFTFTDYY MNWVRQPPGKALEWLGFIGNKANGYTTEYSA SVKGRFTISRDKSQSILYLQMNTLRAEDSATYY CTRDRGLRFYFDYWGQGTTLTVSS |
| 186 | CEA (A5B7P) VL | QTVLSQSPAILSASPGEKVTMTCRASSSVTYIH WYQQKPGSSPKSWIYATSNLASGVPARFSGSG SGTSYSLTISRVEAEDAATYYCQHWSSKPPTFG GGTKLEIK |
| 187 | CEA (431/26)- CDR-H1 | SGYSWH |
| 188 | CEA (431/26)- CDR-H2 | YIQYSGITNYNPSLKS |
| 189 | CEA (431/26)- CDR-H3 | EDYDYHWYFDV |
| 190 | CEA (431/26)- CDR-L1 | STSSSVSYMH |
| 191 | CEA (431/26)- CDR-L2 | STSNLAS |
| 192 | CEA (431/26)- CDR-L3 | HQWSSYPT |
| 193 | CEA (431/26) VH | QVQLQESGPGLVRPSQTLSLTCTVSGFTISSGYS WHWVRQPPGRGLEWIGYIQYSGITNYNPSLKS RVTMLVDTSKNQFSLRLSSVTAADTAVYYCAR EDYDYHWYFDVWGQGSLVTVSS |
| 194 | CEA (431/26) VL | DIQMTQSPSSLSASVGDRVTITCSTSSSVSYMH WYQQKPGKAPKLLIYSTSNLASGVPSRFSGSGS GTDFTFTISSLQPEDIATYYCHQWSSYPTFGQGT KVEIK |
| 195 | VHCH1 (20H4.9)-Heavy chain hole-VL (A5B7P) | see Table 28 |
| 196 | VHCH1 (20H4.9)-Heavy chain knob-VH (A5B7P) | see Table 28 |
| 197 | VHCH1 (20H4.9)-Heavy chain hole-VH (A5B7P) | see Table 29 |
| 198 | VHCH1 (20H4.9)-Heavy chain knob-VL (A5B7P) | see Table 29 |
| 199 | VHCH1 (20H4.9)-Heavy chain hole-VL (431/26) | see Table 30 |
| 200 | VHCH1 (20H4.9)-Heavy chain knob-VH (431/26) | see Table 30 |
| 201 | VHCH1 (20H4.9)-Heavy chain hole-VH (431/26) | see Table 31 |
| 202 | VHCH1 (20H4.9)-Heavy chain knob-VL (431/26) | see Table 31 |
| 203 | VHCH1-VHCH1 (20H4.9)- Heavy chain hole-VL (A5B7P) | see Table 44 |
| 204 | VHCH1-VHCH1 (20H4.9)- Heavy chain knob-VH (A5B7P) | see Table 44 |
| 205 | VHCH1-VHCH1 (20H4.9)- Heavy chain hole-VH (A5B7P) | see Table 45 |
| 206 | VHCH1-VHCH1 (20H4.9)- Heavy chain knob-VL (A5B7P) | see Table 45 |
| 207 | VHCH1-VHCH1 (20H4.9)- Heavy chain hole-VL (431/26) | see Table 46 |

TABLE C-continued (Sequences):

| SEQ ID NO: | Name | Sequence |
|---|---|---|
| 208 | VHCH1-VHCH1 (20H4.9)-Heavy chain knob-VH (431/26) | see Table 46 |
| 209 | VHCH1-VHCH1 (20H4.9)-Heavy chain hole-VH (431/26) | see Table 47 |
| 210 | VHCH1-VHCH1 (20H4.9)-Heavy chain knob-VL (431/26) | see Table 47 |
| 211 | VHCH1 (20H4.9)-Heavy chain knob-VHCL (A5B7P) | see Table 33 |
| 212 | VHCH1 (20H4.9)-Heavy chain hole | see Table 33 |
| 213 | VLCH1-Light chain (A5B7P) | see Table 33 |
| 214 | VHCH1 (20H4.9)-Heavy chain knob-VLCH (A5B7P) (EE mutations) | see Table 34 |
| 215 | VHCH1 (20H4.9)-Heavy chain hole (EE mutations) | see Table 34 |
| 216 | VLCL-Light chain (20H4.9) (RK mutations) | see Table 34 |
| 217 | VHCL-Light chain (A5B7P) | see Table 34 |

All nucleotide sequences are presented without the respective stop codon sequences.

Aspects of the Invention

The following numbered paragraphs (paras) describe aspects of the present invention:

1. A bispecific antigen binding molecule, comprising at least one antigen binding domain capable of specific binding to 4-1BB, at least one antigen binding domain capable of specific binding to a target cell antigen and a Fc domain composed of a first and a second subunit capable of stable association,
wherein the antigen binding domain capable of specific binding to 4-1BB comprises a heavy chain variable region ($V_H$4-1BB) comprising (i) CDR-H1 comprising the amino acid sequence of SEQ ID NO:1, (ii) CDR-H2 comprising the amino acid sequence of SEQ ID NO:2, and (iii) CDR-H3 comprising the amino acid sequence of SEQ ID NO:3, and a light chain variable region ($V_L$4-1BB) comprising (iv) CDR-L1 comprising the amino acid sequence of SEQ ID NO:4, (v) CDR-L2 comprising the amino acid sequence of SEQ ID NO:5, and (vi) CDR-L3 comprising the amino acid sequence of SEQ ID NO:6.

2. The bispecific antigen binding molecule of para 1, wherein the antigen binding domain capable of specific binding to 4-1BB comprises a heavy chain variable region ($V_H$4-1BB) comprising an amino acid sequence that is at least about 95%, 96%, 97%, 98%, 99% or 100% identical to the amino acid sequence of SEQ ID NO:7 and a light chain variable region ($V_L$4-1BB) comprising an amino acid sequence that is at least about 95%, 96%, 97%, 98%, 99% or 100% identical to the amino acid sequence of SEQ ID NO:8.

3. The bispecific antigen binding molecule of paras 1 or 2, wherein the antigen binding domain capable of specific binding to 4-1BB comprises a heavy chain variable region ($V_H$4-1BB) comprising the amino acid sequence of SEQ ID NO:7 and a light chain variable region ($V_L$4-1BB) comprising the amino acid sequence of SEQ ID NO:8.

4. The bispecific antigen binding molecule of any one of paras 1 to 3, wherein antigen binding domain capable of specific binding to 4-1BB is a Fab fragment.

5. The bispecific antigen binding molecule of any one of paras 1 to 4, wherein the target cell antigen is selected from the group consisting of Fibroblast Activation Protein (FAP), Melanoma-associated Chondroitin Sulfate Proteoglycan (MCSP), Epidermal Growth Factor Receptor (EGFR), Carcinoembryonic Antigen (CEA), CD19, CD20 and CD33.

6. The bispecific antigen binding molecule of any one of paras 1 to 5, wherein the antigen binding domain capable of specific binding to a target cell antigen is an antigen binding domain capable of specific binding to Fibroblast Activation Protein (FAP).

7. The bispecific antigen binding molecule of any one of paras 1 to 6, wherein the antigen binding domain capable of specific binding to Fibroblast Activation Protein (FAP) comprises
(a) a heavy chain variable region ($V_H$FAP) comprising (i) CDR-H1 comprising the amino acid sequence of SEQ ID NO:9, (ii) CDR-H2 comprising the amino acid sequence of SEQ ID NO:10, and (iii) CDR-H3 comprising the amino acid sequence of SEQ ID NO:11, and a light chain variable region ($V_L$FAP) comprising (iv) CDR-L1 comprising the amino acid sequence of SEQ ID NO:12, (v) CDR-L2 comprising the amino acid sequence of SEQ ID NO:13, and (vi) CDR-L3 comprising the amino acid sequence of SEQ ID NO:14, or (b) a heavy chain variable region ($V_H$FAP) comprising (i) CDR-H1 comprising the amino acid sequence of SEQ ID NO:15, (ii) CDR-H2 comprising the amino acid sequence of SEQ ID NO:16, and (iii) CDR-H3 comprising the amino acid sequence of SEQ ID NO:17, and a a light chain variable region ($V_L$FAP) comprising (iv) CDR-L1 comprising the amino acid sequence of SEQ ID NO:18, (v) CDR-L2 comprising the amino acid sequence of SEQ ID NO:19, and (vi) CDR-L3 comprising the amino acid sequence of SEQ ID NO:20.

8. The bispecific antigen binding molecule of any one of paras 1 to 7, wherein the antigen binding domain capable of specific binding to Fibroblast Activation Protein (FAP) comprises (a) a heavy chain variable region ($V_H$FAP) comprising an amino acid sequence that is at least about 95%, 96%, 97%, 98%, 99% or 100% identical to the amino acid sequence of SEQ ID NO:21, and a light chain variable region ($V_L$FAP) comprising an amino acid sequence that is at least about 95%, 96%, 97%, 98%, 99% or 100% identical to the amino acid sequence of SEQ ID NO:22, or (b) a heavy chain variable region ($V_H$FAP) comprising an amino acid sequence that is at least about 95%, 96%, 97%, 98%, 99% or 100% identical to the amino acid sequence of SEQ ID NO:23, and a light chain variable region ($V_L$FAP) comprising an amino acid sequence that is at least about 95%, 96%, 97%, 98%, 99% or 100% identical to the amino acid sequence of SEQ ID NO:24.

9. The bispecific antigen binding molecule of any one of paras 1 to 8, wherein
(i) the antigen binding domain capable of specific binding to 4-1BB comprises a heavy chain variable region VH comprising the amino acid sequence of SEQ ID NO: 7 and a light chain variable region comprising an amino acid sequence of SEQ ID NO: 8 and
(ii) the antigen binding domain capable of specific binding to FAP comprises a heavy chain variable region VH comprising an amino acid sequence of SEQ ID NO:23 and a light chain variable region comprising an amino acid sequence of SEQ ID NO:24.

10. The bispecific antigen binding molecule of any one of paras 1 to 8, wherein
(i) the antigen binding domain capable of specific binding to 4-1BB comprises a heavy chain variable region VH comprising the amino acid sequence of SEQ ID NO: 7 and a light chain variable region comprising an amino acid sequence of SEQ ID NO: 8 and
(ii) the antigen binding domain capable of specific binding to FAP comprises a heavy chain variable region VH comprising an amino acid sequence of SEQ ID NO:21 and a light chain variable region comprising an amino acid sequence of SEQ ID NO:22.

11. The bispecific antigen binding molecule of any one of paras 1 to 5, wherein the antigen binding domain capable of specific binding to a target cell antigen is an antigen binding domain capable of specific binding to Carcinoembryonic Antigen (CEA).

12. The bispecific antigen binding molecule of any one of paras 1 to 5 or 11, wherein the antigen binding domain capable of specific binding to Carcinoembryonic Antigen (CEA) comprises (a) a heavy chain variable region ($V_H$CEA) comprising (i) CDR-H1 comprising the amino acid sequence of SEQ ID NO:25, (ii) CDR-H2 comprising the amino acid sequence of SEQ ID NO:26, and (iii) CDR-H3 comprising the amino acid sequence of SEQ ID NO:27, and a light chain variable region ($V_L$CEA) comprising (iv) CDR-L1 comprising the amino acid sequence of SEQ ID NO:28, (v) CDR-L2 comprising the amino acid sequence of SEQ ID NO:29, and (vi) CDR-L3 comprising the amino acid sequence of SEQ ID NO:30, or (b) a heavy chain variable region ($V_H$CEA) comprising (i) CDR-H1 comprising the amino acid sequence of SEQ ID NO:33, (ii) CDR-H2 comprising the amino acid sequence of SEQ ID NO:34, and (iii) CDR-H3 comprising the amino acid sequence of SEQ ID NO:35, and a light chain variable region ($V_L$CEA) comprising (iv) CDR-L1 comprising the amino acid sequence of SEQ ID NO:36, (v) CDR-L2 comprising the amino acid sequence of SEQ ID NO:37, and (vi) CDR-L3 comprising the amino acid sequence of SEQ ID NO:38, or (c) a heavy chain variable region ($V_H$CEA) comprising (i) CDR-H1 comprising the amino acid sequence of SEQ ID NO:179, (ii) CDR-H2 comprising the amino acid sequence of SEQ ID NO:180, and (iii) CDR-H3 comprising the amino acid sequence of SEQ ID NO:181, and a light chain variable region ($V_L$CEA) comprising (iv) CDR-L1 comprising the amino acid sequence of SEQ ID NO:182, (v) CDR-L2 comprising the amino acid sequence of SEQ ID NO:183, and (vi) CDR-L3 comprising the amino acid sequence of SEQ ID NO:184, or (d) a heavy chain variable region ($V_H$CEA) comprising (i) CDR-H1 comprising the amino acid sequence of SEQ ID NO:187, (ii) CDR-H2 comprising the amino acid sequence of SEQ ID NO:188, and (iii) CDR-H3 comprising the amino acid sequence of SEQ ID NO:189, and a light chain variable region ($V_L$CEA) comprising (iv) CDR-L1 comprising the amino acid sequence of SEQ ID NO:190, (v) CDR-L2 comprising the amino acid sequence of SEQ ID NO:191, and (vi) CDR-L3 comprising the amino acid sequence of SEQ ID NO:192.

13. The bispecific antigen binding molecule of any one of paras 1 to 5 or 11 or 12, wherein the antigen binding domain capable of specific binding to Carcinoembryonic Antigen (CEA) comprises (a) a heavy chain variable region ($V_H$CEA) comprising an amino acid sequence that is at least about 95%, 96%, 97%, 98%, 99% or 100% identical to the amino acid sequence of SEQ ID NO:31, and a light chain variable region ($V_L$CEA) comprising an amino acid sequence that is at least about 95%, 96%, 97%, 98%, 99% or 100% identical to the amino acid sequence of SEQ ID NO:32, or (b) a heavy chain variable region ($V_H$CEA) comprising an amino acid sequence that is at least about 95%, 96%, 97%, 98%, 99% or 100% identical to the amino acid sequence of SEQ ID NO:39, and a light chain variable region ($V_L$CEA) comprising an amino acid sequence that is at least about 95%, 96%, 97%, 98%, 99% or 100% identical to the amino acid sequence of SEQ ID NO:40, or (c) a heavy chain variable region ($V_H$CEA) comprising an amino acid sequence that is at least about 95%, 96%, 97%, 98%, 99% or 100% identical to the amino acid sequence of SEQ ID NO:185, and a light chain variable region ($V_L$CEA) comprising an amino acid sequence that is at least about 95%, 96%, 97%, 98%, 99% or 100% identical to the amino acid sequence of SEQ ID NO:186, or (d) a heavy chain variable region ($V_H$CEA) comprising an amino acid sequence that is at least about 95%, 96%, 97%, 98%, 99% or 100% identical to the amino acid sequence of SEQ ID NO:193, and a light chain variable region ($V_L$CEA) comprising an amino acid sequence that is at least about 95%, 96%, 97%, 98%, 99% or 100% identical to the amino acid sequence of SEQ ID NO:194.

14. The bispecific antigen binding molecule of any one of paras 1 to 5 or 11 to 13, wherein
(i) the antigen binding domain capable of specific binding to 4-1BB comprises a heavy chain variable region VH comprising the amino acid sequence of SEQ ID NO: 7 and a light chain variable region comprising an amino acid sequence of SEQ ID NO: 8 and
(ii) the antigen binding domain capable of specific binding to CEA comprises a heavy chain variable region VH comprising an amino acid sequence of SEQ ID NO:31 and a light chain variable region comprising an amino acid sequence of SEQ ID NO:32.

15. The bispecific antigen binding molecule of any one of paras 1 to 5 or 11 to 13, wherein
(i) the antigen binding domain capable of specific binding to 4-1BB comprises a heavy chain variable region VH comprising the amino acid sequence of SEQ ID NO: 7 and a light chain variable region comprising an amino acid sequence of SEQ ID NO: 8 and
(ii) the antigen binding domain capable of specific binding to CEA comprises a heavy chain variable region VH comprising an amino acid sequence of SEQ ID NO:39 and a light chain variable region comprising an amino acid sequence of SEQ ID NO:40.

16. The bispecific antigen binding molecule of any one of paras 1 to 5, wherein the antigen binding domain capable of specific binding to a target cell antigen is an antigen binding domain capable of specific binding to CD19.

17. The bispecific antigen binding molecule of any one of paras 1 to 5 or 16, wherein the antigen binding domain capable of specific binding to CD19 comprises
(a) a heavy chain variable region ($V_H$CD19) comprising (i) CDR-H1 comprising the amino acid sequence of SEQ ID NO:155, (ii) CDR-H2 comprising the amino acid sequence of SEQ ID NO:156, and (iii) CDR-H3 comprising the amino acid sequence of SEQ ID NO:157, and a light chain variable region ($V_L$CD19) comprising (iv) CDR-L1 comprising the amino acid sequence of SEQ ID NO:158, (v) CDR-L2 comprising the amino acid sequence of SEQ ID NO:159, and (vi) CDR-L3 comprising the amino acid sequence of SEQ ID NO:160, or
(b) a heavy chain variable region ($V_H$CD19) comprising (i) CDR-H1 comprising the amino acid sequence of SEQ ID NO:163, (ii) CDR-H2 comprising the amino acid sequence of SEQ ID NO:164, and (iii) CDR-H3 comprising the amino acid sequence of SEQ ID NO:165, and a light chain variable region ($V_L$CD19) comprising (iv) CDR-L1 comprising the amino acid sequence of SEQ ID NO:166, (v) CDR-L2 comprising the amino acid sequence of SEQ ID NO:167, and (vi) CDR-L3 comprising the amino acid sequence of SEQ ID NO:168.

18. The bispecific antigen binding molecule of any one of paras 1 to 5 or 16 or 17, wherein the antigen binding domain capable of specific binding to CD19 comprises (a) a heavy chain variable region ($V_H$CD19) comprising an amino acid sequence that is at least about 95%, 96%, 97%, 98%, 99% or 100% identical to the amino acid sequence of SEQ ID NO:161, and a light chain variable region ($V_L$CD19) comprising an amino acid sequence that is at least about 95%, 96%, 97%, 98%, 99% or 100% identical to the amino acid sequence of SEQ ID NO:162, or (b) a heavy chain variable region ($V_H$CD19) comprising an amino acid sequence that is at least about 95%, 96%, 97%, 98%, 99% or 100% identical to the amino acid sequence of SEQ ID NO:169, and a light chain variable region ($V_L$CD19) comprising an amino acid sequence that is at least about 95%, 96%, 97%, 98%, 99% or 100% identical to the amino acid sequence of SEQ ID NO:170.

19. The bispecific antigen binding molecule of any one of paras 1 to 5 or 16 to 18, wherein
(i) the antigen binding domain capable of specific binding to 4-1BB comprises a heavy chain variable region VH comprising the amino acid sequence of SEQ ID NO: 7 and a light chain variable region comprising an amino acid sequence of SEQ ID NO: 8 and
(ii) the antigen binding domain capable of specific binding to CEA comprises a heavy chain variable region VH comprising an amino acid sequence of SEQ ID NO:161 and a light chain variable region comprising an amino acid sequence of SEQ ID NO:162.

20. The bispecific antigen binding molecule of any one of paras 1 to 5 or 16 to 18, wherein
(i) the antigen binding domain capable of specific binding to 4-1BB comprises a heavy chain variable region VH comprising the amino acid sequence of SEQ ID NO: 7 and a light chain variable region comprising an amino acid sequence of SEQ ID NO: 8 and
(ii) the antigen binding domain capable of specific binding to CEA comprises a heavy chain variable region VH comprising an amino acid sequence of SEQ ID NO:169 and a light chain variable region comprising an amino acid sequence of SEQ ID NO:170.

21. The bispecific antigen binding molecule of any one of paras 1 to 20, wherein the bispecific antigen binding molecule comprises an IgG Fc domain, particularly an IgG1 Fc domain or an IgG4 Fc domain.

22. The bispecific antigen binding molecule of any one of paras 1 to 21, wherein the Fc domain comprises one or more amino acid substitution that reduces the binding affinity of the antigen binding molecule to an Fc receptor and/or effector function.

23. The bispecific antigen binding molecule of any one of paras 1 to 22, wherein the Fc domain is of human IgG1 subclass with the amino acid mutations L234A, L235A and P329G (numbering according to Kabat EU index).

24. The bispecific antigen binding molecule of any one of paras 1 to 23, wherein the Fc domain comprises a modification promoting the association of the first and second subunit of the Fc domain.

25. The bispecific antigen binding molecule of any one of paras 1 to 24, wherein the first subunit of the Fc domain comprises the amino acid substitutions S354C and T366W (numbering according to Kabat EU index) and the second subunit of the Fc domain comprises the amino acid substitutions Y349C, T366S, L368A and Y407V (numbering according to Kabat EU index).

26. The bispecific antigen binding molecule of any one of paras 1 to 25 comprising more than one antigen binding domain capable of specific binding to 4-1BB, wherein each antigen binding domain capable of specific binding to 4-1BB comprises a heavy chain variable region ($V_H$4-1BB) comprising (i) CDR-H1 comprising the amino acid sequence of SEQ ID NO:1, (ii) CDR-H2 comprising the amino acid sequence of SEQ ID NO:2, and (iii) CDR-H3 comprising the amino acid sequence of SEQ ID NO:3, and a light chain variable region ($V_L$4-1BB) comprising (iv) CDR-L1 comprising the amino acid sequence of SEQ ID NO:4, (v) CDR-L2 comprising the amino acid sequence of SEQ ID NO:5, and (vi) CDR-L3 comprising the amino acid sequence of SEQ ID NO:6.

27. The bispecific antigen binding molecule of any one of paras 1 to 26, comprising
(a) two antigen binding domains capable of specific binding to 4-1BB,
(b) one antigen binding domain capable of specific binding to a target cell antigen, and
(c) a Fc domain composed of a first and a second subunit capable of stable association.

28. The bispecific antigen binding molecule of any one of paras 1 to 26, wherein the bispecific antigen binding molecule is bivalent for 4-1BB and monovalent for the target cell antigen.

29. The bispecific antigen binding molecule of paras 1 to 26, comprising
(a) two light chains and two heavy chains of an antibody comprising two Fab fragments capable of specific binding to 4-1BB and the Fc domain, and
(b) a VH and VL domain capable of specific binding to a target cell antigen, wherein the VH domain is connected via a peptide linker to the C-terminus of one of the heavy chains and wherein the VL domain is connected via a peptide linker to the C-terminus of the second heavy chain.

30. The bispecific antigen binding molecule of paras 27 to 29, comprising
(a) two light chains, each comprising the amino acid sequence of SEQ ID NO:46, a first heavy chain comprising the amino acid sequence of SEQ ID NO:44, and a second heavy chain comprising the amino acid sequence of SEQ ID NO:45, or
(b) two light chains, each comprising the amino acid sequence of SEQ ID NO:46, a first heavy chain comprising the amino acid sequence of SEQ ID NO:49, and a second heavy chain comprising the amino acid sequence of SEQ ID NO:50.

31. The bispecific antigen binding molecule of paras 27 to 29, comprising
(a) two light chains, each comprising the amino acid sequence of SEQ ID NO:46, a first heavy chain comprising the amino acid sequence of SEQ ID NO:65, and a second heavy chain comprising the amino acid sequence of SEQ ID NO:66, or
(b) two light chains, each comprising the amino acid sequence of SEQ ID NO:46, a first heavy chain comprising the amino acid sequence of SEQ ID NO:69, and a second heavy chain comprising the amino acid sequence of SEQ ID NO:70, or
(c) two light chains, each comprising the amino acid sequence of SEQ ID NO:46, a first heavy chain comprising the amino acid sequence of SEQ ID NO:73, and a second heavy chain comprising the amino acid sequence of SEQ ID NO:74, or
(d) two light chains, each comprising the amino acid sequence of SEQ ID NO:46, a first heavy chain comprising the amino acid sequence of SEQ ID NO:77, and a second heavy chain comprising the amino acid sequence of SEQ ID NO:78.

32. The bispecific antigen binding molecule of any one of paras 1 to 26, comprising
(a) four antigen binding domains capable of specific binding to 4-1BB,
(b) one antigen binding domain capable of specific binding to a target cell antigen, and
(c) a Fc domain composed of a first and a second subunit capable of stable association.

33. The bispecific antigen binding molecule of any one of paras 1 to 26 or 32, wherein the bispecific antigen binding molecule is tetravalent for 4-1BB and monovalent for the target cell antigen.

34. The bispecific antigen binding molecule of any one of paras 1 to 26 or 32 or 33, wherein the four antigen binding domains capable of specific binding to 4-1BB are Fab fragments and each two thereof are fused to each other, optionally via a peptide linker.

35. The bispecific antigen binding molecule of any one of paras 1 to 26 or 32 to 34, wherein the antigen binding domain capable of specific binding to a target cell antigen comprises a VH and VL domain and wherein the VH domain is connected via a peptide linker to the C-terminus of the first subunit of the Fc domain and the VL domain is connected via a peptide linker to the C-terminus of the second subunit of the Fc domain.

36. The bispecific antigen binding molecule of paras 32 to 35, comprising
(a) four light chains, each comprising the amino acid sequence of SEQ ID NO:46, a first heavy chain comprising the amino acid sequence of SEQ ID NO:57, and a second heavy chain comprising the amino acid sequence of SEQ ID NO:58, or
(b) four light chains, each comprising the amino acid sequence of SEQ ID NO:46, a first heavy chain comprising the amino acid sequence of SEQ ID NO:61, and a second heavy chain comprising the amino acid sequence of SEQ ID NO:62.

37. The bispecific antigen binding molecule of paras 27 to 30, comprising
(a) four light chains, each comprising the amino acid sequence of SEQ ID NO:46, a first heavy chain comprising the amino acid sequence of SEQ ID NO:81, and a second heavy chain comprising the amino acid sequence of SEQ ID NO:82, or
(b) four light chains, each comprising the amino acid sequence of SEQ ID NO:46, a first heavy chain comprising the amino acid sequence of SEQ ID NO:85, and a second heavy chain comprising the amino acid sequence of SEQ ID NO:86, or
(c) four light chains, each comprising the amino acid sequence of SEQ ID NO:46, a first heavy chain comprising the amino acid sequence of SEQ ID NO:89, and a second heavy chain comprising the amino acid sequence of SEQ ID NO:90, or
(d) four light chains, each comprising the amino acid sequence of SEQ ID NO:46, a first heavy chain comprising the amino acid sequence of SEQ ID NO:93, and a second heavy chain comprising the amino acid sequence of SEQ ID NO:94.

38. A polynucleotide encoding the bispecific antigen binding molecule of any one of paras 1 to 37.

39. A pharmaceutical composition comprising a bispecific antigen binding molecule of any one of paras 1 to 37 and at least one pharmaceutically acceptable excipient.

40. The bispecific antigen binding molecule of any one of paras 1 to 37, or the pharmaceutical composition of para 39, for use as a medicament.

41. The bispecific antigen binding molecule of any one of paras 1 to 37, or the pharmaceutical composition of para 39, for use
(i) in stimulating T cell response,
(ii) in supporting survival of activated T cells,
(iii) in the treatment of infections,
(iv) in the treatment of cancer,
(v) in delaying progression of cancer, or
(vi) in prolonging the survival of a patient suffering from cancer.

42. The bispecific antigen binding molecule of any one of paras 1 to 37, or the pharmaceutical composition of para 39, for use in the treatment of cancer.

43. The bispecific antigen binding molecule of any one of paras 1 to 37, or the pharmaceutical composition of para 39, for use in the treatment of cancer, wherein the bispecific antigen binding molecule is administered in combination with a chemotherapeutic agent, radiation and/or other agents for use in cancer immunotherapy.

44. A method of inhibiting the growth of tumor cells in an individual comprising administering to the individual an effective amount of the bispecific antigen binding molecule of any one of paras 1 to 37, or the pharmaceutical composition of para 39, to inhibit the growth of the tumor cells.

EXAMPLES

The following are examples of methods and compositions of the invention. It is understood that various other embodiments may be practiced, given the general description provided above.

Recombinant DNA Techniques

Standard methods were used to manipulate DNA as described in Sambrook et al., Molecular cloning: A laboratory manual; Cold Spring Harbor Laboratory Press, Cold Spring Harbor, N.Y., 1989. The molecular biological reagents were used according to the manufacturer's instructions. General information regarding the nucleotide sequences of human immunoglobulin light and heavy chains is given in: Kabat, E. A. et al., (1991) Sequences of Proteins of Immunological Interest, Fifth Ed., NIH Publication No 91-3242.

DNA Sequencing

DNA sequences were determined by double strand sequencing.

Gene Synthesis

Desired gene segments were either generated by PCR using appropriate templates or were synthesized by Geneart AG (Regensburg, Germany) from synthetic oligonucleotides and PCR products by automated gene synthesis. In cases where no exact gene sequence was available, oligonucleotide primers were designed based on sequences from closest homologues and the genes were isolated by RT-PCR from RNA originating from the appropriate tissue. The gene segments flanked by singular restriction endonuclease cleavage sites were cloned into standard cloning/sequencing vectors. The plasmid DNA was purified from transformed bacteria and concentration determined by UV spectroscopy. The DNA sequence of the subcloned gene fragments was confirmed by DNA sequencing. Gene segments were designed with suitable restriction sites to allow sub-cloning into the respective expression vectors. All constructs were designed with a 5'-end DNA sequence coding for a leader peptide which targets proteins for secretion in eukaryotic cells.

Protein Purification

Proteins were purified from filtered cell culture supernatants referring to standard protocols. In brief, antibodies were applied to a Protein A Sepharose column (GE healthcare) and washed with PBS. Elution of antibodies was achieved at pH 2.8 followed by immediate neutralization of the sample. Aggregated protein was separated from monomeric antibodies by size exclusion chromatography (Superdex 200, GE Healthcare) in PBS or in 20 mM Histidine, 150 mM NaCl pH 6.0. Monomeric antibody fractions were pooled, concentrated (if required) using e.g., a MILLIPORE Amicon Ultra (30 MWCO) centrifugal concentrator, frozen and stored at −20° C. or −80° C. Part of the samples were provided for subsequent protein analytics and analytical characterization e.g. by SDS-PAGE, size exclusion chromatography (SEC) or mass spectrometry.

SDS-PAGE

The NuPAGE® Pre-Cast gel system (Invitrogen) was used according to the manufacturer's instruction. In particular, 10% or 4-12% NuPAGE® Novex® Bis-TRIS Pre-Cast gels (pH 6.4) and a NuPAGE® MES (reduced gels, with NuPAGE® Antioxidant running buffer additive) or MOPS (non-reduced gels) running buffer was used.

Analytical Size Exclusion Chromatography

Size exclusion chromatography (SEC) for the determination of the aggregation and oligomeric state of antibodies was performed by HPLC chromatography. Briefly, Protein A purified antibodies were applied to a Tosoh TSKgel G3000SW column in 300 mM NaCl, 50 mM $KH_2PO_4$/$K_2HPO_4$, pH 7.5 on an Agilent HPLC 1100 system or to a Superdex 200 column (GE Healthcare) in 2×PBS on a Dionex HPLC-System. The eluted protein was quantified by UV absorbance and integration of peak areas. BioRad Gel Filtration Standard 151-1901 served as a standard.

Mass Spectrometry

This section describes the characterization of the multispecific antibodies with VH/VL or CH/CL exchange (CrossMabs) with emphasis on their correct assembly. The expected primary structures were analyzed by electrospray ionization mass spectrometry (ESI-MS) of the deglycosylated intact CrossMabs and deglycosylated/plasmin digested or alternatively deglycosylated/limited LysC digested CrossMabs.

The CrossMabs were deglycosylated with N-Glycosidase F in a phosphate or Tris buffer at 37° C. for up to 17 h at a protein concentration of 1 µg/ml. The plasmin or limited LysC (Roche) digestions were performed with 100 µg deglycosylated VH/VL CrossMabs in a Tris buffer pH 8 at room temperature for 120 hours and at 37° C. for 40 min, respectively. Prior to mass spectrometry the samples were desalted via HPLC on a Sephadex G25 column (GE Healthcare). The total mass was determined via ESI-MS on a maXis 4G UHR-QTOF MS system (Bruker Daltonik) equipped with a TriVersa NanoMate source (Advion).

Further details of the invention are illustrated by the following non-limiting Examples. The disclosures of all citations in the specification are expressly incorporated herein by reference.

Example 1

Figure 1A:
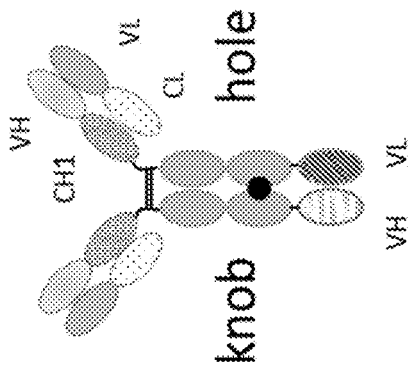

Preparation, Purification and Characterization of Bispecific Antibodies with a Bivalent Binding to 4-1BB and a Monovalent Binding to FAP 1.1 Generation of Bispecific Antibodies with a Bivalent Binding to 4-1BB and a Monovalent Binding to FAP Bispecific agonistic 4-1BB antibodies with bivalent binding for 4-1BB and monovalent binding for FAP, also termed 2+1, were prepared as depicted in FIGS. 1A and 1B. The knobs into hole technology was applied by introducing the S354C/T366W mutations in the first heavy chain HC1 (Fc knob heavy chain) and introducing the Y349C/T366S/L368A/Y407V mutations in the second heavy chain HC2 (Fc hole heavy chain) to allow generation of a heterodimer.

In this example, the first heavy chain HC1 of the construct was comprised of the following components: VHCH1 of anti-4-1BB binder (clone 20H4.9), followed by Fc knob, at which C-terminus a VL or VH of anti-FAP binder was fused. The second heavy chain HC2 was comprised of VHCH1 of anti-4-1BB followed by Fc hole, at which C-terminus a VH or VL, respectively, of anti-FAP binder (clone 4B9) was fused. The generation and preparation of FAP binder 4B9 is described in WO 2012/020006 A2, which is incorporated herein by reference. For the 4-1BB binder, the VH and VL sequences of clone 20H4.9 were obtained in accordance with U.S. Pat. No. 7,288,638 B2 or U.S. Pat. No. 7,659,384 B2. Combination of the two heavy chains allows generation of a heterodimer, which includes a FAP binding moiety and two 4-1BB binding Fabs (FIGS. 1A and 1B).

The Pro329Gly, Leu234Ala and Leu235Ala mutations have been introduced in the constant region of the knob and hole heavy chains to abrogate binding to Fc gamma receptors according to the method described in International Patent Appl. Publ. No. WO2012/130831A1.

The bispecific 2+1 anti-4-1BB anti-FAP huIgG1 P329GLALA antibodies were produced by co-transfecting HEK293-EBNA cells with the mammalian expression vectors using polyethylenimine. The cells were transfected with the corresponding expression vectors in a 1:1:1 ratio ("vector knob heavy chain": "vector light chain":"vector hole heavy chain").

The base pair and amino acid sequences for 2+1 anti-4-1BB, anti-FAP constructs with a-FAP VH fused to the Fc knob heavy chain and VL fused to Fc hole heavy chain can be found respectively in Table 1.

TABLE 1

Sequences of bispecific, bivalent anti-4-1BB/monovalent anti-FAP human IgG1 P329GLALA antigen binding molecules (Constructs with a-FAP VL fused to Fc hole chain and VH fused to Fc knob chain, termed in Table 3 below hole-VL)

| SEQ ID NO: | Description | Sequence |
|---|---|---|
| 41 | VHCH1 (20H4.9)-Heavy chain hole-VL (4B9) (nucleotide sequence) | CAGGTGCAGCTGCAGCAGTGGGGAGCCGGACTGCTGAAG CCTAGCGAGACACTGAGCCTGACCTGCGCCGTGTACGGC GGCAGCTTCAGCGGCTACTACTGGTCCTGGATCAGACAG AGCCCCGAGAAGGGCCTGGAATGGATCGGCGAGATCAAC CACGGCGGCTACGTGACCTACAACCCCAGCCTGGAAAGC AGAGTGACCATCAGCGTGGACACCAGCAAGAACCAGTTC AGCCTGAAGCTGAGCAGCGTGACAGCCGCCGACACAGCC GTGTACTACTGCGCCAGAGATTACGGCCCTGGCAACTACG ACTGGTACTTCGACCTGTGGGGCAGAGGCACCCTCGTGAC CGTGTCTAGCGCTAGCACCAAGGGCCCATCGGTCTTCCCC CTGGCACCCTCCTCCAAGAGCACCTCTGGGGGCACAGCG GCCCTGGGCTGCCTGGTCAAGGACTACTTCCCCGAACCGG TGACGGTGTCGTGGAACTCAGGCGCCCTGACCAGCGGCG TGCACACCTTCCCGGCTGTCCTACAGTCCTCAGGACTCTA CTCCCTCAGCAGCGTGGTGACCGTGCCCTCCAGCAGCTTG GGCACCCAGACCTACATCTGCAACGTGAATCACAAGCCC AGCAACACCAAGGTGGACAAGAAAGTTGAGCCCAAATCT TGTGACAAAACTCACACATGCCCACCGTGCCCAGCACCTG AAGCTGCAGGGGGACCGTCAGTCTTCCTCTTCCCCCCAAA ACCCAAGGACACCCTCATGATCTCCCGGACCCCTGAGGTC ACATGCGTGGTGGTGGACGTGAGCCACGAAGACCCTGAG GTCAAGTTCAACTGGTACGTGGACGGCGTGGAGGTGCAT AATGCCAAGACAAAGCCGCGGGAGGAGCAGTACAACAG CACGTACCGTGTGGTCAGCGTCCTCACCGTCCTGCACCAG GACTGGCTGAATGGCAAGGAGTACAAGTGCAAGGTCTCC AACAAAGCCCTCGGCGCCCCCATCGAGAAAACCATCTCC AAAGCCAAAGGGCAGCCCCGAGAACCACAGGTGTGCACC CTGCCCCCATCCCGGGATGAGCTGACCAAGAACCAGGTC AGCCTCTCGTGCGCAGTCAAAGGCTTCTATCCCAGCGACA TCGCCGTGGAGTGGGAGAGCAATGGGCAGCCGGAGAACA ACTACAAGACCACGCCTCCCGTGCTGGACTCCGACGGCTC CTTCTTCCTCGTGAGCAAGCTCACCGTGGACAAGAGCAGG TGGCAGCAGGGGAACGTCTTCTCATGCTCCGTGATGCATG AGGCTCTGCACAACCACTACACGCAGAAGAGCCTCTCCCT GTCTCCGGGTGGAGGCGGCGGAAGCGGAGGAGGAGGATC CGGCGGCGGAGGTTCCGGAGGCGGAGGATCCGAGATCGT GCTGACCCAGTCTCCCGGCACCCTGTCTCTGAGCCCTGGC GAGAGAGCCACCCTGTCCTGCAGAGCCTCCCAGTCCGTG ACCTCCTCCTACCTCGCCTGGTATCAGCAGAAGCCCGGCC AGGCCCCTCGGCTGCTGATCAACGTGGGCAGTCGGAGAG CCACCGGCATCCCTGACCGGTTCTCCGGCTCTGGCTCCGG CACCGACTTCACCCTGACCATCTCCCGGCTGGAACCCGAG GACTTCGCCGTGTACTACTGCCAGCAGGGCATCATGCTGC CCCCCACCTTTGGCCAGGGCACCAAGGTGGAAATCAAG |
| 42 | VHCH1 (20H4.9)-Heavy chain knob-VH (4B9) (nucleotide sequence) | CAGGTGCAGCTGCAGCAGTGGGGAGCCGGACTGCTGAAG CCTAGCGAGACACTGAGCCTGACCTGCGCCGTGTACGGC GGCAGCTTCAGCGGCTACTACTGGTCCTGGATCAGACAG AGCCCCGAGAAGGGCCTGGAATGGATCGGCGAGATCAAC CACGGCGGCTACGTGACCTACAACCCCAGCCTGGAAAGC AGAGTGACCATCAGCGTGGACACCAGCAAGAACCAGTTC AGCCTGAAGCTGAGCAGCGTGACAGCCGCCGACACAGCC GTGTACTACTGCGCCAGAGATTACGGCCCTGGCAACTACG |

TABLE 1-continued

Sequences of bispecific, bivalent anti-4-1BB/monovalent anti-FAP human IgG1 P329GLALA antigen binding molecules (Constructs with a-FAP VL fused to Fc hole chain and VH fused to Fc knob chain, termed in Table 3 below hole-VL)

| SEQ ID NO: | Description | Sequence |
|---|---|---|
|  |  | ACTGGTACTTCGACCTGTGGGGCAGAGGCACCCTCGTGAC<br>CGTGTCTAGCGCTAGCACCAAGGGCCCATCGGTCTTCCCC<br>CTGGCACCCTCCTCCAAGAGCACCTCTGGGGGCACAGCG<br>GCCCTGGGCTGCCTGGTCAAGGACTACTTCCCCGAACGG<br>TGACGGTGTCGTGGAACTCAGGCGCCCTGACCAGCGGCG<br>TGCACACCTTCCCGGCTGTCCTACAGTCCTCAGGACTCTA<br>CTCCCTCAGCAGCGTGGTGACCGTGCCCTCCAGCAGCTTG<br>GGCACCCAGACCTACATCTGCAACGTGAATCACAAGCCC<br>AGCAACACCAAGGTGGACAAGAAAGTTGAGCCCAAATCT<br>TGTGACAAAACTCACACATGCCCACCGTGCCCAGCACCTG<br>AAGCTGCAGGGGACCGTCAGTCTTCCTCTTCCCCCCAAA<br>ACCCAAGGACACCCTCATGATCTCCCGGACCCCTGAGGTC<br>ACATGCGTGGTGGTGGACGTGAGCCACGAAGACCCTGAG<br>GTCAAGTTCAACTGGTACGTGGACGGCGTGGAGGTGCAT<br>AATGCCAAGACAAAGCCGCGGGAGGAGCAGTACAACAG<br>CACGTACCGTGTGGTCAGCGTCCTCACCGTCCTGCACCAG<br>GACTGGCTGAATGGCAAGGAGTACAAGTGCAAGGTCTCC<br>AACAAAGCCCTCGGCGCCCCCATCGAGAAAACCATCTCC<br>AAAGCCAAAGGGCAGCCCCGAGAACCACAGGTGTACACC<br>CTGCCCCCTGCAGAGATGAGCTGACCAAGAACCAGGTG<br>TCCCTGTGGTGTCTGGTCAAGGGCTTCTACCCCAGCGATA<br>TCGCCGTGGAGTGGGAGAGCAACGGCCAGCCTGAGAACA<br>ACTACAAGACCACCCCCCCTGTGCTGGACAGCGACGGCA<br>GCTTCTTCCTGTACTCCAAACTGACCGTGGACAAGAGCCG<br>GTGGCAGCAGGGCAACGTGTTCAGCTGCAGCGTGATGCA<br>CGAGGCCCTGCACAACCACTACACCCAGAAGTCCCTGAG<br>CCTGAGCCCCGGCGGAGGCGGCGGAAGCGGAGGAGGAG<br>GATCTGGGGGCGGAGGTTCCGGAGGCGGTGGATCTGAGG<br>TGCAGCTGCTCGAAAGCGGCGGAGGACTGGTGCAGCCTG<br>GCGGCAGCCTGAGACTGTCTTGCGCCGCCAGCGGCTTCAC<br>CTTCAGCAGCTACGCCATGAGCTGGGTCCGCCAGGCCCCT<br>GGCAAGGGACTGGAATGGGTGTCCGCCATCATCGGCTCT<br>GGCGCCAGCACCTACTACGCCGACAGCGTGAAGGGCCGG<br>TTCACCATCAGCCGGGACAACAGCAAGAACACCCTGTAC<br>CTGCAGATGAACAGCCTGCGGGCCGAGGACACCGCCGTG<br>TACTACTGCGCCAAGGGATGGTTCGGCGGCTTCAACTACT<br>GGGGACAGGGCACCCTGGTCACCGTGTCCAGC |
| 43 | VLCL-Light chain (20H4.9) (nucleotide sequence) | GAGATCGTGCTGACCCAGAGCCCCGCCACCCTGTCTCTGA<br>GCCCTGGCGAGAGAGCCACCCTGAGCTGCAGAGCCAGCC<br>AGAGCGTGTCCAGCTACCTGGCTTGGTATCAGCAGAAGC<br>CCGGCCAGGCCCCCAGACTGCTGATCTACGACGCCAGCA<br>ACCGGGCCACCGGCATCCCTGCCAGATTTTCTGGCAGCGG<br>CAGCGGCACCGACTTCACCCTGACCATCAGCAGCCTGGA<br>ACCCGAGGACTTCGCCGTGTACTACTGCCAGCAGCGGAG<br>CAACTGGCCCCCTGCCCTGACCTTCGGCGGCGGCACCAAG<br>GTGGAAATCAAGCGTACGGTGGCTGCACCATCTGTCTTCA<br>TCTTCCCGCCATCTGATGAGCAGTTGAAATCTGGAACTGC<br>CTCTGTTGTGTGCCTGCTGAATAACTTCTATCCCAGAGAG<br>GCCAAAGTACAGTGGAAGGTGGATAACGCCCTCCAATCG<br>GGTAACTCCCAGGAGAGTGTCACAGAGCAGGACAGCAAG<br>GACAGCACCTACAGCCTCAGCAGCACCCTGACGCTGAGC<br>AAAGCAGACTACGAGAAACACAAAGTCTACGCCTGCGAA<br>GTCACCCATCAGGGCCTGAGCTCGCCCGTCACAAAGAGC<br>TTCAACAGGGGAGAGTGT |
| 44 | VHCH1 (20H4.9)-Heavy chain hole-VL (4B9) | QVQLQQWGAGLLKPSETLSLTCAVYGGSFSGYYWSWIRQS<br>PEKGLEWIGEINHGGYVTYNPSLESRVTISVDTSKNQFSLKLS<br>SVTAADTAVYYCARDYGPGNYDWYFDLWGRGTLVTVSSA<br>STKGPSVFPLAPSSKSTSGGTAALGCLVKDYFPEPVTVSWNS<br>GALTSGVHTFPAVLQSSGLYSLSSVVTVPSSSLGTQTYICNV<br>NHKPSNTKVDKKVEPKSCDKTHTCPPCPAPEAAGGPSVFLFP<br>PKPKDTLMISRTPEVTCVVVDVSHEDPEVKFNWYVDGVEV<br>HNAKTKPREEQYNSTYRVVSVLTVLHQDWLNGKEYKCKVS<br>NKALGAPIEKTISKAKGQPREPQVCTLPPSRDELTKNQVSLS<br>CAVKGFYPSDIAVEWESNGQPENNYKTTPPVLDSDGSFFLVS<br>KLTVDKSRWQQGNVFSCSVMHEALHNHYTQKSLSLSPGGG<br>GGSGGGGSGGGGSGGGGSEIVLTQSPGTLSLSPGERATLSCR<br>ASQSVTSSYLAWYQQKPGQAPRLLINVGSRRATGIPDRFSGS<br>GSGTDFTLTISRLEPEDFAVYYCQQGIMLPPTFGQGTKVEIK |

TABLE 1-continued

Sequences of bispecific, bivalent anti-4-1BB/monovalent anti-FAP human IgG1 P329GLALA antigen binding molecules (Constructs with a-FAP VL fused to Fc hole chain and VH fused to Fc knob chain, termed in Table 3 below hole-VL)

| SEQ ID NO: | Description | Sequence |
|---|---|---|
| 45 | VHCH1 (20H4.9)-Heavy chain knob-VH (4B9) | QVQLQQWGAGLLKPSETLSLTCAVYGGSFSGYYWSWIRQS PEKGLEWIGEINHGGYVTYNPSLESRVTISVDTSKNQFSLKLS SVTAADTAVYYCARDYGPGNYDWYFDLWGRGTLVTVSSA STKGPSVFPLAPSSKSTSGGTAALGCLVKDYFPEPVTVSWNS GALTSGVHTFPAVLQSSGLYSLSSVVTVPSSSLGTQTYICNV NHKPSNTKVDKKVEPKSCDKTHTCPPCPAPEAAGGPSVFLFP PKPKDTLMISRTPEVTCVVVDVSHEDPEVKFNWYVDGVEV HNAKTKPREEQYNSTYRVVSVLTVLHQDWLNGKEYKCKVS NKALGAPIEKTISKAKGQPREPQVYTLPPCRDELTKNQVSLW CLVKGFYPSDIAVEWESNGQPENNYKTTPPVLDSDGSFFLYS KLTVDKSRWQQGNVFSCSVMHEALHNHYTQKSLSLSPGGG GGSGGGGSGGGGSGGGGSEVQLLESGGGLVQPGGSLRLSC AASGFTFSSYAMSWVRQAPGKGLEWVSAIIGSGASTYYADS VKGRFTISRDNSKNTLYLQMNSLRAEDTAVYYCAKGWFGG FNYWGQGTLVTVSS |
| 46 | VLCL-Light chain (20H4.9) | EIVLTQSPATLSLSPGERATLSCRASQSVSSYLAWYQQKPGQ APRLLIYDASNRATGIPARFSGSGSGTDFTLTISSLEPEDFAVY YCQQRSNWPPALTFGGGTKVEIKRTVAAPSVFIFPPSDEQLK SGTASVVCLLNNFYPREAKVQWKVDNALQSGNSQESVTEQ DSKDSTYSLSSTLTLSKADYEKHKVYACEVTHQGLSSPVTK SFNRGEC |

The base pair and amino acid sequences for 2+1 anti-4-1BB, anti-FAP constructs with a-FAP VL fused to the Fc knob heavy chain and VH fused to Fc hole heavy chain can be found respectively in Table 2.

TABLE 2

Sequences of bispecific, bivalent anti-4-1BB/monovalent anti-FAP human IgG1 P329GLALA antigen binding molecules (Constructs with a-FAP VH fusedto Fc hole chain and VL fused to Fc knob chain, termed in Table 3 below hole-VH)

| SEQ ID NO: | Description | Sequence |
|---|---|---|
| 47 | VHCH1 (20H4.9)-Heavy chain hole-VH (4B9) (nucleotide sequence) | CAGGTGCAGCTGCAGCAGTGGGGAGCCGGCCTGCTGAAG CCCAGCGAGACACTGAGCCTGACCTGCGCCGTGTACGGC GGCAGCTTCAGCGGCTACTACTGGTCCTGGATCCGGCAGA GCCCCGAGAAGGGCCTGGAATGGATCGGCGAGATCAACC ACGGCGGCTACGTGACCTACAACCCCAGCCTGGAAAGCA GAGTGACCATCAGCGTGGACACCAGCAAGAACCAGTTCA GCCTGAAGCTGAGCAGCGTGACAGCCGCCGACACCGCCG TGTACTACTGCGCCAGAGACTACGGCCCTGGCAACTACG ACTGGTACTTCGACCTGTGGGGCAGAGGCACCCTGGTGA CAGTGTCCAGCGCTAGCACCAAGGGCCCATCGGTCTTCC CCCTGGCACCCTCCTCCAAGAGCACCTCTGGGGGCACAGC GGCCCTGGGCTGCCTGGTCAAGGACTACTTCCCCGAACCG GTGACGGTGTCGTGGAACTCAGGCGCCCTGACCAGCGGC GTGCACACCTTCCCGGCTGTCCTACAGTCCTCAGGACTCT ACTCCCTCAGCAGCGTGGTGACCGTGCCCTCCAGCAGCTT GGGCACCCAGACCTACATCTGCAACGTGAATCACAAGCC CAGCAACACCAAGGTGGACAAGAAAGTTGAGCCCAAATC TTGTGACAAAACTCACACATGCCCACCGTGCCCAGCACCT GAAGCTGCAGGGGACCGTCAGTCTTCCTCTTCCCCCCAA AACCCAAGGACACCCTCATGATCTCCCGGACCCCTGAGGT CACATGCGTGGTGGTGGACGTGAGCCACGAAGACCCTGA GGTCAAGTTCAACTGGTACGTGGACGGCGTGGAGGTGCA TAATGCCAAGACAAAGCCGCGGGAGGAGCAGTACAACAG CACGTACCGTGTGGTCAGCGTCCTCACCGTCCTGCACCAG GACTGGCTGAATGGCAAGGAGTACAAGTGCAAGGTCTCC AACAAAGCCCTCGGCGCCCCCATCGAGAAAACCATCTCC AAAGCCAAAGGGCAGCCCCGAGAACCACAGGTGTGCACC CTGCCCCCATCCCGGGATGAGCTGACCAAGAACCAGGTC AGCCTCTCGTGCGCAGTCAAAGGCTTCTATCCCAGCGACA TCGCCGTGGAGTGGGAGAGCAATGGGCAGCCGGAGAACA ACTACAAGACCACGCCTCCCGTGCTGGACTCCGACGGCTC CTTCTTCCTCGTGAGCAAGCTCACCGTGGACAAGAGCAGG |

TABLE 2-continued

Sequences of bispecific, bivalent anti-4-1BB/monovalent anti-FAP human IgG1 P329GLALA antigen binding molecules (Constructs with a-FAP VH fused to Fc hole chain and VL fused to Fc knob chain, termed in Table 3 below hole-VH)

| SEQ ID NO: | Description | Sequence |
|---|---|---|
|  |  | TGGCAGCAGGGGAACGTCTTCTCATGCTCCGTGATGCATG<br>AGGCTCTGCACAACCACTACACGCAGAAGAGCCTCTCCCT<br>GTCTCCGGGTGGAGGCGGCGGAAGCGGAGGAGGAGGATC<br>CGGCGGCGGAGGTTCCGGAGGCGGAGGATCCGAGGTGCA<br>GCTGCTCGAAAGCGGCGGAGGACTGGTGCAGCCTGGCGG<br>CAGCCTGAGACTGTCTTGCGCCGCCAGCGGCTTCACCTTC<br>AGCAGCTACGCCATGAGCTGGGTCCGCCAGGCCCCTGGC<br>AAGGGACTGGAATGGGTGTCCGCCATCATCGGCTCTGGC<br>GCCAGCACCTACTACGCCGACAGCGTGAAGGGCCGGTTC<br>ACCATCAGCCGGGACAACAGCAAGAACACCCTGTACCTG<br>CAGATGAACAGCCTGCGGGCCGAGGACACCGCCGTGTAC<br>TACTGCGCCAAGGGATGGTTCGGCGGCTTCAACTACTGGG<br>GACAGGGCACCCTGGTCACCGTGTCCAGC |
| 48 | VHCH1 (20H4.9)-Heavy chain knob-VL (4B9) (nucleotide sequence) | AGGTGCAGCTGCAGCAGTGGGGAGCCGGCCTGCTGAAGC<br>CCAGCGAGACACTGAGCCTGACCTGCGCCGTGTACGGCG<br>GCAGCTTCAGCGGCTACTACTGGTCCTGGATCCGGCAGA<br>GCCCCGAGAAGGGCCTGGAATGGATCGGCGAGATCAACCA<br>CGGCGGCTACGTGACCTACAACCCCAGCCTGGAAAGCAG<br>AGTGACCATCAGCGTGGACACCAGCAAGAACCAGTTCAG<br>CCTGAAGCTGAGCAGCGTGACAGCCGCCGACACCGCCGT<br>GTACTACTGCGCCAGAGACTACGGCCCTGGCAACTACGA<br>CTGGTACTTCGACCTGTGGGGCAGAGGCACCCTGGTGAC<br>AGTGTCCAGCGCTAGCACCAAGGGCCCATCGGTCTTCCCC<br>CTGGCACCCTCCTCCAAGAGCACCTCTGGGGGCACAGCG<br>GCCCTGGGCTGCCTGGTCAAGGACTACTTCCCCGAACCGG<br>TGACGGTGTCGTGGAACTCAGGCGCCCTGACCAGCGGCG<br>TGCACACCTTCCCGGCTGTCCTACAGTCCTCAGGACTCTA<br>CTCCCTCAGCAGCGTGGTGACCGTGCCCTCCAGCAGCTTG<br>GGCACCCAGACCTACATCTGCAACGTGAATCACAAGCCC<br>AGCAACACCAAGGTGGACAAGAAAGTTGAGCCCAAATCT<br>TGTGACAAAACTCACACATGCCCACCGTGCCCAGCACCTG<br>AAGCTGCAGGGGGACCGTCAGTCTTCCTCTTCCCCCCAAA<br>ACCCAAGGACACCCTCATGATCTCCCGGACCCCTGAGGTC<br>ACATGCGTGGTGGTGGACGTGAGCCACGAAGACCCTGAG<br>GTCAAGTTCAACTGGTACGTGGACGGCGTGGAGGTGCAT<br>AATGCCAAGACAAAGCCGCGGGAGGAGCAGTACAACAG<br>CACGTACCGTGTGGTCAGCGTCCTCACCGTCCTGCACCAG<br>GACTGGCTGAATGGCAAGGAGTACAAGTGCAAGGTCTCC<br>AACAAAGCCCTCGGCGCCCCCATCGAGAAAACCATCTCC<br>AAAGCCAAAGGGCAGCCCCGAGAACCACAGGTGTACACC<br>CTGCCCCCCTGCAGAGATGAGCTGACCAAGAACCAGGTG<br>TCCCTGTGGTGTCTGGTCAAGGGCTTCTACCCCAGCGATA<br>TCGCCGTGGAGTGGGAGAGCAACGGCCAGCCTGAGAACA<br>ACTACAAGACCACCCCCCCTGTGCTGGACAGCGACGGCA<br>GCTTCTTCCTGTACTCCAAACTGACCGTGGACAAGAGCCG<br>GTGGCAGCAGGGCAACGTGTTCAGCTGCAGCGTGATGCA<br>CGAGGCCCTGCACAACCACTACACCCAGAAGTCCCTGAG<br>CCTGAGCCCCGGCGGAGGCGGCGGAAGCGGAGGAGGAG<br>GATCTGGGGGCGGAGGTTCCGGAGGCGGTGGATCTGAGA<br>TCGTGCTGACCCAGTCTCCCGGCACCCTGTCTCTGAGCCC<br>TGGCGAGAGAGCCACCCTGTCCTGCAGAGCCTCCCAGTCC<br>GTGACCTCCTCCTACCTCGCCTGGTATCAGCAGAAGCCCG<br>GCCAGGCCCCTCGGCTGCTGATCAACGTGGGCAGTCGGA<br>GAGCCACCGGCATCCCTGACCGGTTCTCCGGCTCTGGCTC<br>CGGCACCGACTTCACCCTGACCATCTCCCGGCTGGAACCC<br>GAGGACTTCGCCGTGTACTACTGCCAGCAGGGCATCATGC<br>TGCCCCCCACCTTTGGCCAGGGCACCAAGGTGGAAATCA<br>AG |
| 43 | VLCL-Light chain (20H4.9) (nucleotide sequence) | see Table 1 |
| 49 | VHCH1 (20H4.9)-Heavy chain hole-VH (4B9) | QVQLQQWGAGLLKPSETLSLTCAVYGGSFSGYYWSWIRQS<br>PEKGLEWIGEINHGGYVTYNPSLESRVTISVDTSKNQFSLKLS<br>SVTAADTAVYYCARDYGPGNYDWYFDLWGRGTLVTVSSA<br>STKGPSVFPLAPSSKSTSGGTAALGCLVKDYFPEPVTVSWNS<br>GALTSGVHTFPAVLQSSGLYSLSSVVTVPSSSLGTQTYICNV<br>NHKPSNTKVDKKVEPKSCDKTHTCPPCPAPEAAGGPSVFLFP<br>PKPKDTLMISRTPEVTCVVVDVSHEDPEVKFNWYVDGVEV |

TABLE 2-continued

Sequences of bispecific, bivalent anti-4-1BB/monovalent anti-FAP human IgG1 P329GLALA antigen binding molecules (Constructs with a-FAP VH fusedto Fc hole chain and VL fused to Fc knob chain, termed in Table 3 below hole-VH)

| SEQ ID NO: | Description | Sequence |
|---|---|---|
|  |  | HNAKTKPREEQYNSTYRVVSVLTVLHQDWLNGKEYKCKVS<br>NKALGAPIEKTISKAKGQPREPQVCTLPPSRDELTKNQVSLS<br>CAVKGFYPSDIAVEWESNGQPENNYKTTPPVLDSDGSFFLVS<br>KLTVDKSRWQQGNVFSCSVMHEALHNHYTQKSLSLSPGGG<br>GGSGGGGSGGGGSGGGGSEVQLLESGGGLVQPGGSLRLSC<br>AASGFTFSSYAMSWVRQAPGKGLEWVSAIIGSGASTYYADS<br>VKGRFTISRDNSKNTLYLQMNSLRAEDTAVYYCAKGWFGG<br>FNYWGQGTLVTVSS |
| 50 | VHCH1 (20H4.9)-Heavy chain knob-VL (4B9) | QVQLQQWGAGLLKPSETLSLTCAVYGGSFSGYYWSWIRQS<br>PEKGLEWIGEINHGGYVTYNPSLESRVTISVDTSKNQFSLKLS<br>SVTAADTAVYYCARDYGPGNYDWYFDLWGRGTLVTVSSA<br>STKGPSVFPLAPSSKSTSGGTAALGCLVKDYFPEPVTVSWNS<br>GALTSGVHTFPAVLQSSGLYSLSSVVTVPSSSLGTQTYICNV<br>NHKPSNTKVDKKVEPKSCDKTHTCPPCPAPEAAGGPSVFLFP<br>PKPKDTLMISRTPEVTCVVVDVSHEDPEVKFNWYVDGVEV<br>HNAKTKPREEQYNSTYRVVSVLTVLHQDWLNGKEYKCKVS<br>NKALGAPIEKTISKAKGQPREPQVYTLPPCRDELTKNQVSLW<br>CLVKGFYPSDIAVEWESNGQPENNYKTTPPVLDSDGSFFLYS<br>KLTVDKSRWQQGNVFSCSVMHEALHNHYTQKSLSLSPGGG<br>GGSGGGGSGGGGSGGGGSEIVLTQSPGTLSLSPGERATLSCR<br>ASQSVTSSYLAWYQQKPGQAPRLLINVGSRRATGIPDRFSGS<br>GSGTDFTLTISRLEPEDFAVYYCQQGIMLPPTFGQGTKVEIK |
| 46 | VLCL-Light chain (20H4.9) | see Table 1 |

For production in 500 mL shake flasks, 400 million HEK293 EBNA cells were seeded 24 hours before transfection. For transfection cells were centrifuged for 5 minutes by 210×g, and supernatant was replaced by pre-warmed CD CHO medium. Expression vectors were mixed in 20 mL CD CHO medium to a final amount of 200 µg DNA. After addition of 540 µL PEI, the solution was vortexed for 15 seconds and incubated for 10 minutes at room temperature. Afterwards, cells were mixed with the DNA/PEI solution, transferred to a 500 mL shake flask and incubated for 3 hours at 37° C. in an incubator with a 5% $CO_2$ atmosphere. After the incubation, 160 mL F17 medium was added and cells were cultured for 24 hours. One day after transfection 1 mM valproic acid and 7% Feed were added. After culturing for 7 days, the cell supernatant was collected by centrifugation for 15 minutes at 210×g. The solution was sterile filtered (0.22 µm filter), supplemented with sodium azide to a final concentration of 0.01% (w/v), and kept at 4° C.

Secreted proteins were purified from cell culture supernatants by affinity chromatography using Protein A, followed by size exclusion chromatography. For affinity chromatography, the supernatant was loaded on a HiTrap ProteinA HP column (CV=5 mL, GE Healthcare) equilibrated with 40 mL 20 mM sodium phosphate, 20 mM sodium citrate pH 7.5. Unbound protein was removed by washing with at least 10 column volumes of 20 mM sodium phosphate, 20 mM sodium citrate, 0.5 M sodium chloride containing buffer (pH 7.5). The bound protein was eluted using a linear pH-gradient of sodium chloride (from 0 to 500 mM) created over 20 column volumes of 20 mM sodium citrate, 0.01% (v/v) Tween-20, pH 3.0. The column was then washed with 10 column volumes of 20 mM sodium citrate, 500 mM sodium chloride, 0.01% (v/v) Tween-20, pH 3.0. The pH of collected fractions was adjusted by adding 1/40 (v/v) of 2M Tris, pH8.0. The protein was concentrated and filtered prior to loading on a HiLoad Superdex 200 column (GE Healthcare) equilibrated with 2 mM MOPS, 150 mM sodium chloride, 0.02% (w/v) sodium azide solution of pH 7.4. The protein was concentrated and filtered prior to loading on a HiLoad Superdex 200 column (GE Healthcare) equilibrated with 20 mM Histidine, 140 mM NaCl solution of pH 6.0.

The protein concentration of purified bispecific constructs was determined by measuring the OD at 280 nm, using the molar extinction coefficient calculated on the basis of the amino acid sequence. Purity and molecular weight of the bispecific constructs were analyzed by CE-SDS in the presence and absence of a reducing agent (Invitrogen, USA) using a LabChipGXII (Caliper). The aggregate content of bispecific constructs was analyzed using a TSKgel G3000 SW XL analytical size-exclusion column (Tosoh) equilibrated in a 25 mM $K_2HPO_4$, 125 mM NaCl, 200 mM L-Arginine Monohydrocloride, 0.02% (w/v) $NaN_3$, pH 6.7 running buffer at 25° C. (Table 3).

TABLE 3

Biochemical analysis of bispecific antigen binding molecules with a bivalent binding to 4-1BB and a monovalent binding to FAP (2 + 1 4-1BB/FAP human IgG1 P329GLALA)

| Molecule | Monomer [%] | Yield [mg/l] | CE-SDS (non-red) |
|---|---|---|---|
| 4-1BB (20H4.9)/FAP (4B9) P329GLALA IgG1 2 + 1 (hole-VH) | 97.7 | 14 | 90 |

Preparation of Antigen and Screening Tool Human 4-1BB Fc (kih)

The DNA sequences encoding the ectodomain of human 4-1BB (synthesized according to Q07011) was subcloned in frame with the human IgG1 heavy chain CH2 and CH3 domains on the knob. An AcTEV protease cleavage site was introduced between an antigen ectodomain and the Fc of human IgG1. An Avi tag for directed biotinylation was introduced at the C-terminus of the antigen-Fc knob. Combination of the antigen-Fc knob chain containing the S354C/T366W mutations, with a Fc hole chain containing the Y349C/T366S/L368A/Y407V mutations allows generation of a heterodimer which includes a single copy of 4-1BB ectodomain containing chain, thus creating a monomeric form of Fc-linked antigen. Table 4 shows the cDNA and amino acid sequences of the antigen Fc-fusion constructs.

TABLE 4 cDNA and amino acid sequences of monomeric antigen Fc(kih) fusion molecules (produced by combination of one Fc hole chain with one antigen Fc knob chain)

| SEQ ID NO: | Antigen | Sequence |
| --- | --- | --- |
| 51 | Nucleotide sequence Fc hole chain | GACAAAACTCACACATGCCCACCGTGCCCAGCACCTGAA CTCCTGGGGGGACCGTCAGTCTTCCTCTTCCCCCCAAAAC CCAAGGACACCCTCATGATCTCCCGGACCCCTGAGGTCAC ATGCGTGGTGGTGGACGTGAGCCACGAAGACCCTGAGGT CAAGTTCAACTGGTACGTGGACGGCGTGGAGGTGCATAA TGCCAAGACAAAGCCGCGGGAGGAGCAGTACAACAGCAC GTACCGTGTGGTCAGCGTCCTCACCGTCCTGCACCAGGAC TGGCTGAATGGCAAGGAGTACAAGTGCAAGGTCTCCAAC AAAGCCCTCCCAGCCCCCATCGAGAAAACCATCTCCAAA GCCAAAGGGCAGCCCCGAGAACCACAGGTGTGCACCCTG CCCCCATCCCGGGATGAGCTGACCAAGAACCAGGTCAGC CTCTCGTGCGCAGTCAAAGGCTTCTATCCCAGCGACATCG CCGTGGAGTGGGAGAGCAATGGGCAGCCGGAGAACAACT ACAAGACCACGCCTCCCGTGCTGGACTCCGACGGCTCCTT CTTCCTCGTGAGCAAGCTCACCGTGGACAAGAGCAGGTG GCAGCAGGGGAACGTCTTCTCATGCTCCGTGATGCATGAG GCTCTGCACAACCACTACACGCAGAAGAGCCTCTCCCTGT CTCCGGGTAAA |
| 52 | Nucleotide sequence human 4-1BB antigen Fc knob chain | CTGCAGGACCCCTGCAGCAACTGCCCTGCCGGCACCTTCT GCGACAACAACCGGAACCAGATCTGCAGCCCCTGCCCCC CCAACAGCTTCAGCTCTGCCGGCGGACAGCGGACCTGCG ACATCTGCAGACAGTGCAAGGGCGTGTTCAGAACCCGGA AGAGTGCAGCAGCACCAGCAACGCCGAGTGCGACTGCA CCCCCGGCTTCCATTGTCTGGGAGCCGGCTGCAGCATGTG CGAGCAGGACTGCAAGCAGGGCCAGGAACTGACCAAGA AGGGCTGCAAGGACTGCTGCTTCGGCACCTTCAACGACC AGAAGCGGGGCATCTGCCGGCCCTGGACCAACTGTAGCC TGGACGGCAAGAGCGTGCTGGTCAACGGCACCAAAGAAC GGGACGTCGTGTGCGGCCCCAGCCCTGCTGATCTGTCTCC TGGGGCCAGCAGCGTGACCCCTCCTGCCCCTGCCAGAGA GCCTGGCCACTCTCCTCAGGTCGACGAACAGTTATATTTT CAGGGCGGCTCACCCAAATCTGCAGACAAAACTCACACA TGCCCACCGTGCCCAGCACCTGAACTCCTGGGGGGACCGT CAGTCTTCCTCTTCCCCCCAAAACCCAAGGACACCCTCAT GATCTCCCGGACCCCTGAGGTCACATGCGTGGTGGTGGAC GTGAGCCACGAAGACCCTGAGGTCAAGTTCAACTGGTAC GTGGACGGCGTGGAGGTGCATAATGCCAAGACAAAGCCG CGGGAGGAGCAGTACAACAGCACGTACCGTGTGGTCAGC GTCCTCACCGTCCTGCACCAGGACTGGCTGAATGGCAAG GAGTACAAGTGCAAGGTCTCCAACAAAGCCCTCCCAGCC CCCATCGAGAAAACCATCTCCAAAGCCAAAGGGCAGCCC CGAGAACCACAGGTGTACACCCTGCCCCCATGCCGGGAT GAGCTGACCAAGAACCAGGTCAGCCTGTGGTGCCTGGTC AAAGGCTTCTATCCCAGCGACATCGCCGTGGAGTGGGAG AGCAATGGGCAGCCGGAGAACAACTACAAGACCACGCCT CCCGTGCTGGACTCCGACGGCTCCTTCTTCCTCTACAGCA AGCTCACCGTGGACAAGAGCAGGTGGCAGCAGGGGAACG TCTTCTCATGCTCCGTGATGCATGAGGCTCTGCACAACCA CTACACGCAGAAGAGCCTCTCCCTGTCTCCGGGTAAATCC GGAGGCCTGAACGACATCTTCGAGGCCCAGAAGATTGAA TGGCACGAG |
| 53 | Fc hole chain | DKTHTCPPCPAPELLGGPSVFLFPPKPKDTLMISRTPEVTCVV VDVSHEDPEVKFNWYVDGVEVHNAKTKPREEQYNSTYRV VSVLTVLHQDWLNGKEYKCKVSNKALPAPIEKTISKAKGQP REPQVCTLPPSRDELTKNQVSLSCAVKGFYPSDIAVEWESNG QPENNYKTTPPVLDSDGSFFLVSKLTVDKSRWQQGNVFSCS VMHEALHNHYTQKSLSLSPGK |
| 54 | human 4-1BB antigen Fc knob chain | LQDPCSNCPAGTFCDNNRNQICSPCPPNSFSSAGGQRTCDIC RQCKGVFRTRKECSSTSNAECDCTPGFHCLGAGCSMCEQDC KQGQELTKKGCKDCCFGTFNDQKRGICRPWTNCSLDGKSV LVNGTKERDVVCGPSPADLSPGASSVTPPAPAREPGHSPQVD EQLYFQGGSPKSADKTHTCPPCPAPELLGGPSVFLFPPKPKD TLMISRTPEVTCVVVDVSHEDPEVKFNWYVDGVEVHNAKT |

TABLE 4-continued cDNA and amino acid sequences of monomeric antigen Fc(kih) fusion
molecules (produced by combination of one Fc hole chain with
one antigen Fc knob chain)

| SEQ ID NO: | Antigen | Sequence |
|---|---|---|
| | | KPREEQYNSTYRVVSVLTVLHQDWLNGKEYKCKVSNKALP
APIEKTISKAKGQPREPQVYTLPPCRDELTKNQVSLWCLVKG
FYPSDIAVEWESNGQPENNYKTTPPVLDSDGSFFLYSKLTVD
KSRWQQGNVFSCSVMHEALHNHYTQKSLSLSPGKSGGLNDI
FEAQKIEWHE |

1.2 Binding of Bispecific Antibodies Targeting 4-1BB Bivalent and FAP Monovalent (2+1 Antigen Binding Molecules)

1.2.1 Surface Plasmon Resonance (Simultaneous Binding)

The capacity of binding simultaneously to human 4-1BB Fc (kih) and human FAP was assessed by surface plasmon resonance (SPR). All SPR experiments were performed on a Biacore T200 at 25° C. with HBS-EP as running buffer (0.01 M HEPES pH 7.4, 0.15 M NaCl, 3 mM EDTA, 0.005% Surfactant P20, Biacore, Freiburg/Germany).

Biotinylated human 4-1BB Fc(kih) was directly coupled to a flow cell of a streptavidin (SA) sensor chip. Immobilization levels up to 400 resonance units (RU) were used. The bispecific antibodies targeting 4-1BB and FAP were passed at a concentration range of 200 nM with a flow of 30 µL/minute through the flow cells over 90 seconds and dissociation was set to zero sec. Human FAP was injected as second analyte with a flow of 30 µL/minute through the flow cells over 90 seconds at a concentration of 500 nM. The dissociation was monitored for 120 sec. Bulk refractive index differences were corrected for by subtracting the response obtained in a reference flow cell, where no protein was immobilized. The setup of the assay is shown in FIG. 2A.

Figure 2B:
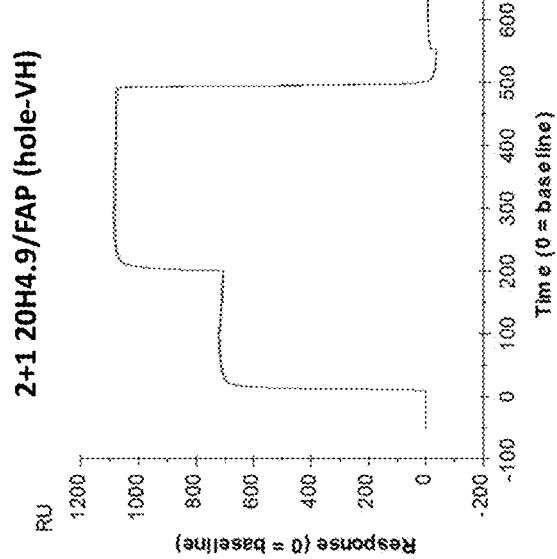
FIGS. 2A and 2B relate to the simultaneous binding of bispecific 2+1 anti-4-1BB and anti-FAP antigen binding molecules.
Figure 2A:
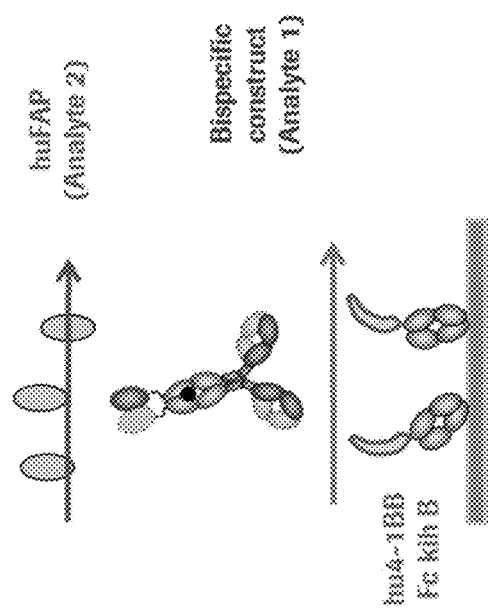

All bispecific constructs could bind simultaneously to human 4-1BB and human FAP (FIG. 2B).

Figure 3:
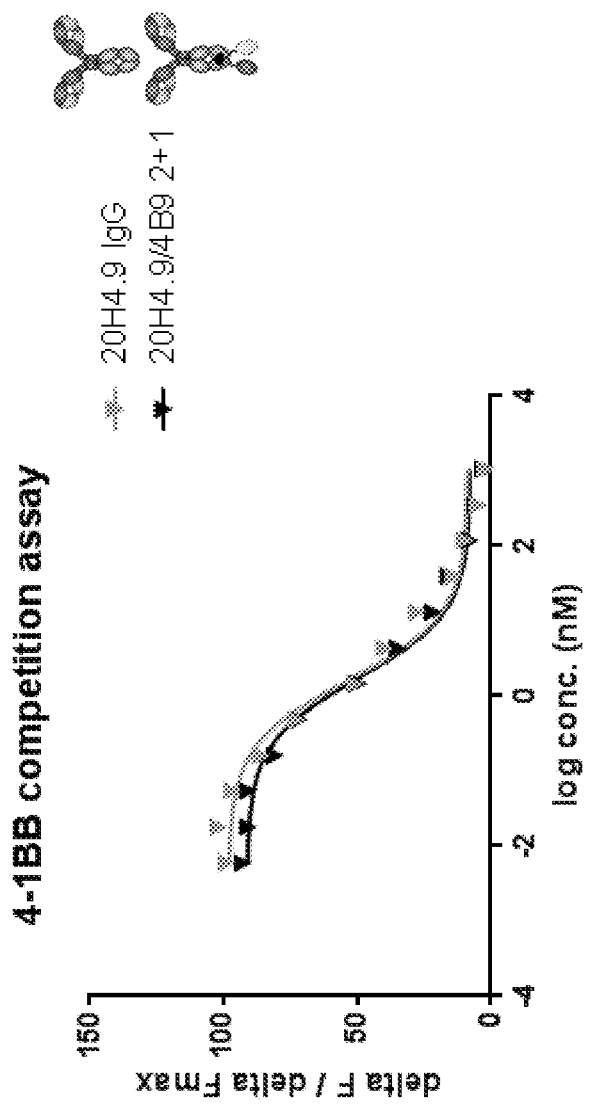
FIG. 3 shows a FRET based competition assay to assess the binding of the bivalent (IgG) anti-41BB (20H4.9) antibody and bivalent (2+1) anti-4-1BB (20H4.9)/anti-FAP (4B9) antigen binding molecules to membrane bound 4-1BB. The bispecific, bivalent (2+1) anti-4-1BB (20H4.9)/anti-FAP (4B9) antigen binding molecule competes as the IgG counterpart.

1.2.2 Binding to Human 4-1BB—Competition Assay of Bivalent Anti-4-1BB Antigen Binding Molecules To confirm the ability of our 2+1 anti-4-1BB antigen binding molecules to bind to hu 4-1BB, a cell-based FRET assay (TagLite) was applied. Therefore, 2500 Hek293 EBNA cells/well transfected with a hu4-1BB-SNAP fusion and labeled with the FRET donor Terbium (Cisbio) and were mixed with either 0.6 nM anti-4-1BB 20H4.9 labeled with the FRET acceptor d2 (Cisbio). Additionally, a concentration dilution ranging from 0.006-1000 nM of the unlabeled IgGs (20H4.9) or bivalent (20H4.9/4B9 2+1) bispecific antibodies was added and incubated for 2-4 hours at RT. The fluorescent signal was measured at 620 nm for the fluorescent donor (Terbium) and at 665 nm for the fluorescent acceptor dye (M100 Pro, Tecan). The ratio of 665/620*1000 was calculated, and the reference (cells only) was subtracted. For $EC_{50}$ value determination the results were analysed in Graph Pad Prism6. The observed $EC_{50}$ values after 4 hour of incubation are shown in Table 5. The competition of the bispecific 2+1 anti-4-1BB and anti-FAP antigen binding molecule (20H4.9/4B9 2+1) is as the one observed for the parental IgG (FIG. 3).

TABLE 5

$EC_{50}$ values for competitive binding of bivalent
4-1BB antigen binding molecules

| Construct | $EC_{50}$ (nM) |
|---|---|
| 20H4.9 IgG | 1.5 (0.9-2.5) |
| 4-1BB(20H4.9)/
FAP(4B9) 2 + 1 | 1.6 (1.2-2.3) |

Example 2

Figure 4A:
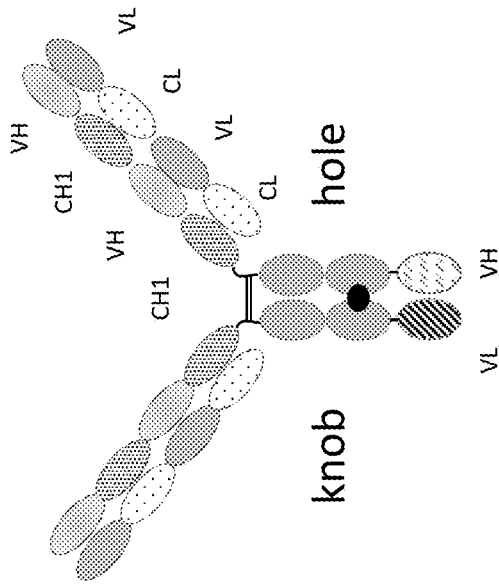
FIGS. 4A and 4B show examples of bispecific antigen binding molecules in huIgG1 P329GLALA format comprising four anti-4-1BB Fab fragments (tetravalent binding to 4-1BB) and a VH and VL domain capable of specific binding to a target cell antigen, for example anti-FAP, anti-CEA or anti-CD19, fused at the C-terminus of the heavy chains, respectively. This format is termed herein also 4+1 format. The black dot symbolizes the knobs-into-holes mutations. Each two of the VHCH1 domains of the anti-4-1BB Fab domains are fused to each other and to the Fc domain.
Figure 4B:
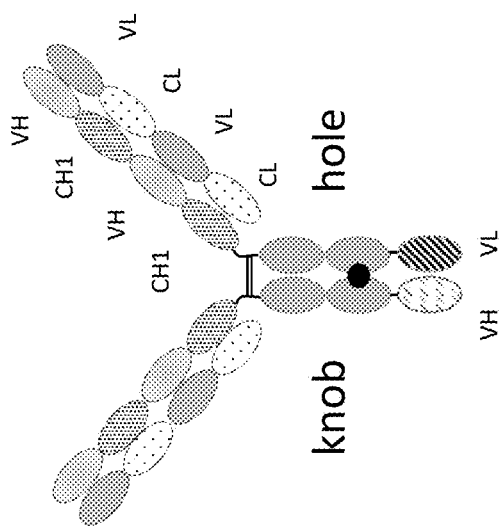

Preparation, Purification and Characterization of Bispecific Antibodies with a Tetravalent Binding to 4-1BB and a Monovalent Binding to FAP 2.1 Generation of Bispecific Antibodies with a Tetravalent Binding to 4-1BB and a Monovalent Binding to FAP Bispecific agonistic 4-1BB antibodies with tetravalent binding for 4-1BB and monovalent binding for FAP, also termed 4+1, were prepared as depicted in FIGS. 4A and 4B. The knobs into hole technology was applied by introducing the S354C/T366W mutations in the first heavy chain HC1 (Fc knob heavy chain) and introducing the Y349C/T366S/L368A/Y407V mutations in the second heavy chain HC2 (Fc hole heavy chain) to allow generation of a heterodimer.

In this example, the first heavy chain HC1 of the construct was comprised of the following components: VHCH1_VHCH1 of anti-4-1BB binder (clone 20H4.9), followed by Fc hole, at which C-terminus a VL or VH of anti-FAP binder (clone 4B9) was fused. The second heavy chain HC2 was comprised of VHCH1_VHCH1 of anti-4-1BB binder (clone 20H4.9), followed by Fc knob, at which C-terminus a VH or VL, respectively, of anti-FAP binder (clone 4B9) was fused. The generation and preparation of FAP binder 4B9 is described in WO 2012/020006 A2, which is incorporated herein by reference. For the 4-1BB binder, the VH and VL sequences of clone 20H4.9 were obtained in accordance with U.S. Pat. No. 7,288,638 B2 or U.S. Pat. No. 7,659,384 B2. Combination of the two heavy chains allows generation of a heterodimer, which includes a FAP binding moiety and four 4-1BB binding Fabs.

The Pro329Gly, Leu234Ala and Leu235Ala mutations have been introduced in the constant region of the knob and hole heavy chains to abrogate binding to Fc gamma receptors according to the method described in International Patent Appl. Publ. No. WO2012/130831A1.

The bispecific 4+1 anti-4-1BB anti-FAP huIgG1 P329GLALA antigen binding molecules were produced by co-transfecting HEK293-EBNA cells with the mammalian expression vectors using polyethylenimine. The cells were transfected with the corresponding expression vectors in a 1:1:1 ratio ("vector knob heavy chain": "vector light chain": "vector hole heavy chain").

The antigen binding molecule was produced and purified as described for the bispecific bivalent anti-4-1BB and anti-FAP huIgG1 P329GLALA (see Example 1.1).

The base pair and amino acid sequences for 4+1 anti-4-1BB, anti-FAP constructs with a-FAP VH fused to the Fc knob heavy chain and VL fused to Fc hole heavy chain can be found respectively in Table 6. The base pair and amino acid sequences for 4+1 anti-4-1BB, anti-FAP constructs with a-FAP VL fused to Fc knob heavy chain and VH fused to Fc hole heavy chain can be found respectively in Table 7.

TABLE 6

Sequences of bispecific, tetravalent anti-4-1BB/monovalent anti-FAP human IgG1 P329GLALA antigen binding molecules (Constructs with a-FAP VL fused to Fc hole chain and VH fused to Fc knob chain, termed hole-VL)

| SEQ ID NO: | Description | Sequence |
|---|---|---|
| 55 | VHCH1-VHCH1 (20H4.9)-Heavy chain hole-VL(4B9) (nucleotide sequence) | CAGGTGCAGCTGCAGCAGTGGGGAGCCGGACTGCTGAAG CCTAGCGAGACACTGAGCCTGACCTGCGCCGTGTACGGC GGCAGCTTCAGCGGCTACTACTGGTCCTGGATCAGACAG AGCCCCGAGAAGGGCCTGGAATGGATCGGCGAGATCAAC CACGGCGGCTACGTGACCTACAACCCCAGCCTGGAAAGC AGAGTGACCATCAGCGTGGACACCAGCAAGAACCAGTTC AGCCTGAAGCTGAGCAGCGTGACAGCCGCCGACACAGCC GTGTACTACTGCGCCAGAGATTACGGCCCTGGCAACTACG ACTGGTACTTCGACCTGTGGGGCAGAGGCACCCTCGTGAC CGTGTCTAGCGCTTCTACCAAGGGCCCAGCGTGTTCCCT CTGGCCCCTAGCAGCAAGAGCACATCTGGCGGAACAGCC GCCCTGGGCTGCCTCGTGAAGGACTACTTTCCCGAGCCCG TGACAGTGTCCTGGAACTCTGGCGCCCTGACAAGCGGCGT GCACACCTTTCCAGCCGTGCTGCAGAGCAGCGGCCTGTAC TCTCTGAGCAGCGTCGTGACTGTGCCCAGCAGCAGCCTGG GAACCCAGACCTACATCTGCAACGTGAACCACAAGCCCA GCAACACCAAGGTGGACAAGAAGGTGGAACCCAAGAGCT GCGACGGCGGAGGCGGATCTGGCGGCGGAGGATCCCAGG TGCAGCTGCAGCAGTGGGGCGCTGGCCTGCTGAAACCCT CTGAGACTCTGTCCCTGACATGTGCTGTGTATGGCGGCTC CTTCTCCGGCTACTATTGGAGCTGGATTCGGCAGTCCCCT GAGAAAGGACTGGAATGGATTGGGGAAATCAATCATGGG GGATATGTGACATACAATCCCTCACTGGAATCCCGCGTGA CCATCTCCGTGGATACCTCTAAGAATCAGTTCTCTCTGAA GCTGTCCTCCGTGACCGCCGCTGATACCGCTGTGTATTAC TGTGCCCGGGACTACGGACCCGGCAATTATGATTGGTATT TTGATCTGTGGGGACGGGGCACACTCGTGACTGTGTCCTC TGCTAGCACCAAGGGCCCATCGGTCTTCCCCCTGGCACCC TCCTCCAAGAGCACCTCTGGGGGCACAGCGGCCCTGGGC TGCCTGGTCAAGGACTACTTCCCCGAACCGGTGACGGTGT CGTGGAACTCAGGCGCCCTGACCAGCGGCGTGCACACCT TCCCGGCTGTCCTACAGTCCTCAGGACTCTACTCCCTCAG CAGCGTGGTGACCGTGCCCTCCAGCAGCTTGGGCACCCA GACCTACATCTGCAACGTGAATCACAAGCCCAGCAACAC CAAGGTGGACAAGAAAGTTGAGCCCAAATCTTGTGACAA AACTCACACATGCCCACCGTGCCCAGCACCTGAAGCTGC AGGGGGACCGTCAGTCTTCCTCTTCCCCCCAAAACCCAAG GACACCCTCATGATCTCCCGGACCCCTGAGGTCACATGCG TGGTGGTGGACGTGAGCCACGAAGACCCTGAGGTCAAGT TCAACTGGTACGTGGACGGCGTGGAGGTGCATAATGCCA AGACAAAGCCGCGGGAGGAGCAGTACAACAGCACGTACC GTGTGGTCAGCGTCCTCACCGTCCTGCACCAGGACTGGCT GAATGGCAAGGAGTACAAGTGCAAGGTCTCCAACAAAGC CCTCGGCGCCCCCATCGAGAAAACCATCTCCAAAGCCAA AGGGCAGCCCCGAGAACCACAGGTGTGCACCCTGCCCCC ATCCCGGGATGAGCTGACCAAGAACCAGGTCAGCCTCTC GTGCGCAGTCAAAGGCTTCTATCCCAGCGACATCGCCGTG GAGTGGGAGAGCAATGGGCAGCCGGAGAACAACTACAA GACCACGCCTCCCGTGCTGGACTCCGACGGCTCCTTCTTC CTCGTGAGCAAGCTCACCGTGGACAAGAGCAGGTGGCAG CAGGGGAACGTCTTCTCATGCTCCGTGATGCATGAGGCTC TGCACAACCACTACACGCAGAAGAGCCTCTCCCTGTCTCC GGGTGGAGGCGGCGGAAGCGGAGGAGGAGGATCCGGCG GCGGAGGTTCCGGAGGCGGTGGATCTGAGATCGTGCTGA CCCAGTCTCCCGGCACCCTGTCTCTGAGCCCTGGCGAGAG AGCCACCCTGTCCTGCAGAGCCTCCCAGTCCGTGACCTCC TCCTACCTCGCCTGGTATCAGCAGAAGCCCGGCCAGGCCC CTCGGCTGCTGATCAACGTGGGCAGTCGGAGAGCCACCG GCATCCCTGACCGGTTCTCCGGCTCTGGCTCCGGCACCGA CTTCACCCTGACCATCTCCCGGCTGGAACCCGAGGACTTC GCCGTGTACTACTGCCAGCAGGGCATCATGCTGCCCCCCA CCTTTGGCCAGGGCACCAAGGTGGAAATCAAG |

TABLE 6-continued

Sequences of bispecific, tetravalent anti-4-1BB/monovalent anti-FAP human IgG1 P329GLALA antigen binding molecules (Constructs with a-FAP VL fused to Fc hole chain and VH fused to Fc knob chain, termed hole-VL)

| SEQ ID NO: | Description | Sequence |
|---|---|---|
| 56 | VHCH1-VHCH (20H4.9)-Heavy chain knob-VH(4B9) (nucleotide sequence) | CAGGTGCAGCTGCAGCAGTGGGGAGCCGGACTGCTGAAG CCTAGCGAGACACTGAGCCTGACCTGCGCCGTGTACGGC GGCAGCTTCAGCGGCTACTACTGGTCCTGGATCAGACAG AGCCCCGAGAAGGGCCTGGAATGGATCGGCGAGATCAAC CACGGCGGCTACGTGACCTACAACCCCAGCCTGGAAAGC AGAGTGACCATCAGCGTGGACACCAGCAAGAACCAGTTC AGCCTGAAGCTGAGCAGCGTGACAGCCGCCGACACAGCC GTGTACTACTGCGCCAGAGATTACGGCCCTGGCAACTACG ACTGGTACTTCGACCTGTGGGGCAGAGGCACCCTCGTGAC CGTGTCTAGCGCTTCTACCAAGGGCCCCAGCGTGTTCCCT CTGGCCCCTAGCAGCAAGAGCACATCTGGCGGAACAGCC GCCCTGGGCTGCCTCGTGAAGGACTACTTTCCCGAGCCCG TGACAGTGTCCTGGAACTCTGGCGCCCTGACAAGCGGCGT GCACACCTTTCCAGCCGTGCTGCAGAGCAGCGGCCTGTAC TCTCTGAGCAGCGTCGTGACTGTGCCCAGCAGCAGCCTGG GAACCCAGACCTACATCTGCAACGTGAACCACAAGCCCA GCAACACCAAGGTGGACAAGAAGGTGGAACCCAAGAGCT GCGACGGCGGAGGCGGATCTGGCGGCGGAGGATCCCAGG TGCAGCTGCAGCAGTGGGGCGCTGGCCTGCTGAAACCCT CTGAGACTCTGTCCCTGACATGTGCTGTGTATGGCGGCTC CTTCTCCGGCTACTATTGGAGCTGGATTCGGCAGTCCCCT GAGAAAGGACTGGAATGGATTGGGGAAATCAATCATGGG GGATATGTGACATACAATCCCTCACTGGAATCCCGCGTGA CCATCTCCGTGGATACCTCTAAGAATCAGTTCTCTCTGAA GCTGTCCTCCGTGACCGCCGCTGATACCGCTGTGTATTAC TGTGCCCGGGACTACGGACCCGGCAATTATGATTGGTATT TTGATCTGTGGGGACGGGGCACACTCGTGACTGTGTCCTC TGCTAGCACCAAGGGCCCATCGGTCTTCCCCCTGGCACCC TCCTCCAAGAGCACCTCTGGGGGCACAGCGGCCCTGGGC TGCCTGGTCAAGGACTACTTCCCCGAACCGGTGACGGTGT CGTGGAACTCAGGCGCCCTGACCAGCGGCGTGCACACCT TCCCGGCTGTCCTACAGTCCTCAGGACTCTACTCCCTCAG CAGCGTGGTGACCGTGCCCTCCAGCAGCTTGGGCACCCA GACCTACATCTGCAACGTGAATCACAAGCCCAGCAACAC CAAGGTGGACAAGAAAGTTGAGCCCAAATCTTGTGACAA AACTCACACATGCCCACCGTGCCCAGCACCTGAAGCTGC AGGGGGACCGTCAGTCTTCCTCTTCCCCCCAAAACCCAAG GACACCCTCATGATCTCCCGGACCCCTGAGGTCACATGCG TGGTGGTGGACGTGAGCCACGAAGACCCTGAGGTCAAGT TCAACTGGTACGTGGACGGCGTGGAGGTGCATAATGCCA AGACAAAGCCGCGGGAGGAGCAGTACAACAGCACGTACC GTGTGGTCAGCGTCCTCACCGTCCTGCACCAGGACTGGCT GAATGGCAAGGAGTACAAGTGCAAGGTCTCCAACAAAGC CCTCGGCGCCCCCATCGAGAAAACCATCTCCAAAGCCAA AGGGCAGCCCCGAGAACCACAGGTGTACACCCTGCCCCC CTGCAGAGATGAGCTGACCAAGAACCAGGTGTCCCTGTG GTGTCTGGTCAAGGGCTTCTACCCCAGCGATATCGCCGTG GAGTGGGAGAGCAACGGCCAGCCTGAGAACAACTACAAG ACCACCCCCCCTGTGCTGGACAGCGACGGCAGCTTCTTCC TGTACTCCAAACTGACCGTGGACAAGAGCCGGTGGCAGC AGGGCAACGTGTTCAGCTGCAGCGTGATGCACGAGGCCC TGCACAACCACTACACCCAGAAGTCCCTGAGCCTGAGCC CCGGCGAGGCGGCGGAAGCGGAGGAGGAGGATCTGGG GGCGGAGGTTCCGGAGGCGGAGGATCCGAGGTGCAGCTG CTCGAAAGCGGCGGAGGACTGGTGCAGCCTGGCGGCAGC CTGAGACTGTCTTGCGCCGCCAGCGGCTTCACCTTCAGCA GCTACGCCATGAGCTGGGTCCGCCAGGCCCCTGGCAAGG GACTGGAATGGGTGTCCGCCATCATCGGCTCTGGCGCCAG CACCTACTACGCCGACAGCGTGAAGGGCCGGTTCACCAT CAGCCGGGACAACAGCAAGAACACCCTGTACCTGCAGAT GAACAGCCTGCGGGCCGAGGACACCGCCGTGTACTACTG CGCCAAGGGATGGTTCGGCGGCTTCAACTACTGGGGACA GGGCACCCTGGTCACCGTGTCCAGC |
| 43 | VLCL-Light chain (20H4.9) (nucleotide sequence) | see Table 1 |

TABLE 6-continued

Sequences of bispecific, tetravalent anti-4-1BB/monovalent
anti-FAP human IgG1 P329GLALA antigen binding molecules
(Constructs with a-FAP VL fused to Fc hole chain
and VH fused to Fc knob chain, termed hole-VL)

| SEQ ID NO: | Description | Sequence |
|---|---|---|
| 57 | VHCH1-VHCH1 (20H4.9)-Heavy chain hole-VL (4B9) | QVQLQQWGAGLLKPSETLSLTCAVYGGSFSGYYWSIRQS PEKGLEWIGEINHGGYVTYNPSLESRVTISVDTSKNQFSLKLS SVTAADTAVYYCARDYGPGNYDWYFDLWGRGTLVTVSSA STKGPSVFPLAPSSKSTSGGTAALGCLVKDYFPEPVTVSWNS GALTSGVHTFPAVLQSSGLYSLSSVVTVPSSSLGTQTYICNV NHKPSNTKVDKKVEPKSCDGGGGSGGGGSQVQLQQWGAG LLKPSETLSLTCAVYGGSFSGYYWSIRQSPEKGLEWIGEIN HGGYVTYNPSLESRVTISVDTSKNQFSLKLSSVTAADTAVY YCARDYGPGNYDWYFDLWGRGTLVTVSSASTKGPSVFPLA PSSKSTSGGTAALGCLVKDYFPEPVTVSWNSGALTSGVHTFP AVLQSSGLYSLSSVVTVPSSSLGTQTYICNVNHKPSNTKVDK KVEPKSCDKTHTCPPCPAPEAAGGPSVFLFPPKPKDTLMISR TPEVTCVVVDVSHEDPEVKFNWYVDGVEVHNAKTKPREEQ YNSTYRVVSVLTVLHQDWLNGKEYKCKVSNKALGAPIEKTI SKAKGQPREPQVCTLPPSRDELTKNQVSLSCAVKGFYPSDIA VEWESNGQPENNYKTTPPVLDSDGSFFLVSKLTVDKSRWQQ GNVFSCSVMHEALHNHYTQKSLSLSPGGGGSGGGGSGGG GSGGGGSEIVLTQSPGTLSLSPGERATLSCRASQSVTSSYLA WYQQKPGQAPRLLINVGSRRATGIPDRFSGSGSGTDFTLTIS RLEPEDFAVYYCQQGIMLPPTFGQGTKVEIK |
| 58 | VHCH1-VHCH1 (20H4.9)-Heavy chain knob-VH (4B9) | QVQLQQWGAGLLKPSETLSLTCAVYGGSFSGYYWSIRQS PEKGLEWIGEINHGGYVTYNPSLESRVTISVDTSKNQFSLKLS SVTAADTAVYYCARDYGPGNYDWYFDLWGRGTLVTVSSA STKGPSVFPLAPSSKSTSGGTAALGCLVKDYFPEPVTVSWNS GALTSGVHTFPAVLQSSGLYSLSSVVTVPSSSLGTQTYICNV NHKPSNTKVDKKVEPKSCDGGGGSGGGGSQVQLQQWGAG LLKPSETLSLTCAVYGGSFSGYYWSIRQSPEKGLEWIGEIN HGGYVTYNPSLESRVTISVDTSKNQFSLKLSSVTAADTAVY YCARDYGPGNYDWYFDLWGRGTLVTVSSASTKGPSVFPLA PSSKSTSGGTAALGCLVKDYFPEPVTVSWNSGALTSGVHTFP AVLQSSGLYSLSSVVTVPSSSLGTQTYICNVNHKPSNTKVDK KVEPKSCDKTHTCPPCPAPEAAGGPSVFLFPPKPKDTLMISR TPEVTCVVVDVSHEDPEVKFNWYVDGVEVHNAKTKPREEQ YNSTYRVVSVLTVLHQDWLNGKEYKCKVSNKALGAPIEKTI SKAKGQPREPQVYTLPPCRDELTKNQVSLWCLVKGFYPSDI AVEWESNGQPENNYKTTPPVLDSDGSFFLYSKLTVDKSRWQ QGNVFSCSVMHEALHNHYTQKSLSLSPGGGGSGGGGSGG GGSGGGGSEVQLLESGGGLVQPGGSLRLSCAASGFTFSSYA MSWVRQAPGKGLEWVSAIIGSGASTYYADSVKGRFTISRDN SKNTLYLQMNSLRAEDTAVYYCAKGWFGGFNYWGQGTLV TVSS |
| 46 | VLCL-Light chain (20H4.9) | see Table 1 |

TABLE 7

Sequences of bispecific, tetravalent anti-4-1BB/monovalent anti-FAP
human IgG1 P329GLALA antigen binding molecules (Constructs with
a-FAP VH fused to Fc hole chain and VL fused to
Fc knob chain, termed hole-VH)

| SEQ ID NO: | Description | Sequence |
|---|---|---|
| 59 | VHCH1-VHCH1 (20H4.9)-Heavy chain hole-VH (4B9) (nucleotide sequence) | CAGGTGCAGCTGCAGCAGTGGGGAGCCGGACTGCTGAAG CCTAGCGAGACACTGAGCCTGACCTGCGCCGTGTACGGC GGCAGCTTCAGCGGCTACTACTGGTCCTGGATCAGACAG AGCCCCGAGAAGGGCCTGGAATGGATCGGCGAGATCAAC CACGGCGGCTACGTGACCTACAACCCCAGCCTGGAAAGC AGAGTGACCATCAGCGTGGACACCAGCAAGAACCAGTTC AGCCTGAAGCTGAGCAGCGTGACAGCCGCCGACACAGCC GTGTACTACTGCGCCCGAGATTACGGCCCTGGCAACTACG ACTGGTACTTCGACCTGTGGGGCAGAGGCACCCTCGTGAC CGTGTCTAGCGCTTCCACAAAGGGCCCCAGCGTGTTCCCT CTGGCCCCTAGCAGCAAGAGCACATCTGGCGGAACAGCC GCCCTGGGCTGCCTCGTGAAGGACTACTTTCCCGAGCCCG |

TABLE 7-continued

Sequences of bispecific, tetravalent anti-4-1BB/monovalent anti-FAP human IgG1 P329GLALA antigen binding molecules (Constructs with a-FAP VH fused to Fc hole chain and VL fused to Fc knob chain, termed hole-VH)

| SEQ ID NO: | Description | Sequence |
|---|---|---|
|  |  | TGACAGTGTCCTGGAACTCTGGCGCCCTGACAAGCGGCGT GCACACCTTTCCAGCCGTGCTGCAGAGCAGCGGCCTGTAC TCTCTGTCCAGCGTCGTGACTGTGCCCAGCAGCAGCCTGG GCACCCAGACCTACATCTGCAACGTGAACCACAAGCCCA GCAACACCAAGGTGGACAAGAAGGTGGAACCCAAGAGCT GCGACGGCGGAGGCGGATCTGGCGGCGGAGGATCCCAGG TGCAGCTGCAGCAGTGGGGCGCTGGCCTGCTGAAACCCT CTGAGACTCTGTCCCTGACATGTGCTGTGTATGGCGGCTC CTTCTCCGGCTACTATTGGAGCTGGATTCGGCAGTCCCCT GAGAAAGGACTGGAATGGATTGGGGAAATCAATCATGGG GGATATGTGACATACAATCCCTCACTGGAATCCCGCGTGA CCATCTCCGTGGATACCTCTAAGAATCAGTTCTCTCTGAA GCTGTCCTCCGTGACCGCCGCTGATACCGCTGTGTATTAC TGTGCCCGGGACTACGGACCCGGCAATTATGATTGGTATT TTGATCTGTGGGGACGGGGCACACTCGTGACTGTGTCCTC TGCTAGCACCAAGGGCCCATCGGTCTTCCCCCTGGCACCC TCCTCCAAGAGCACCTCTGGGGGCACAGCGGCCCTGGGC TGCCTGGTCAAGGACTACTTCCCCGAACCGGTGACGGTGT CGTGGAACTCAGGCGCCCTGACCAGCGGCGTGCACACCT TCCCGGCTGTCCTACAGTCCTCAGGACTCTACTCCCTCAG CAGCGTGGTGACCGTGCCCTCCAGCAGCTTGGGCACCCA GACCTACATCTGCAACGTGAATCACAAGCCCAGCAACAC CAAGGTGGACAAGAAAGTTGAGCCCAAATCTTGTGACAA AACTCACACATGCCCACCGTGCCCAGCACCTGAAGCTGC AGGGGGACCGTCAGTCTTCCTCTTCCCCCCAAAACCCAAG GACACCCTCATGATCTCCCGGACCCCTGAGGTCACATGCG TGGTGGTGGACGTGAGCCACGAAGACCCTGAGGTCAAGT TCAACTGGTACGTGGACGGCGTGGAGGTGCATAATGCCA AGACAAAGCCGCGGGAGGAGCAGTACAACAGCACGTACC GTGTGGTCAGCGTCCTCACCGTCCTGCACCAGGACTGGCT GAATGGCAAGGAGTACAAGTGCAAGGTCTCCAACAAAGC CCTCGGCGCCCCCATCGAGAAAACCATCTCCAAAGCCAA AGGGCAGCCCCGAGAACCACAGGTGTGCACCCTGCCCCC ATCCCGGGATGAGCTGACCAAGAACCAGGTCAGCCTCTC GTGCGCAGTCAAAGGCTTCTATCCCAGCGACATCGCCGTG GAGTGGGAGAGCAATGGGCAGCCGGAGAACAACTACAA GACCACGCCTCCCGTGCTGGACTCCGACGGCTCCTTCTTC CTCGTGAGCAAGCTCACCGTGGACAAGAGCAGGTGGCAG CAGGGGAACGTCTTCTCATGCTCCGTGATGCATGAGGCTC TGCACAACCACTACACGCAGAAGAGCCTCTCCCTGTCTCC GGGTGGAGGCGGCGAAGCGGAGGAGGAGGATCCGGCG GCGGAGGTTCCGGAGGCGGAGGATCCGAGGTGCAGCTGC TCGAAAGCGGCGGAGGACTGGTGCAGCCTGGCGGCAGCC TGAGACTGTCTTGCGCCGCCAGCGGCTTCACCTTCAGCAG CTACGCCATGAGCTGGGTCCGCCAGGCCCCTGGCAAGGG ACTGGAATGGGTGTCCGCCATCATCGGCTCTGGCGCCAGC ACCTACTACGCCGACAGCGTGAAGGGCCGGTTCACCATC AGCCGGGACAACAGCAAGAACACCCTGTACCTGCAGATG AACAGCCTGCGGGCCGAGGACACCGCCGTGTACTACTGC GCCAAGGGATGGTTCGGCGGCTTCAACTACTGGGGACAG GGCACCCTGGTCACCGTGTCCAGC |
| 60 | VHCH1-VHCH1 (20H4.9)-Heavy chain knob-VL (4B9) (nucleotide sequence) | CAGGTGCAGCTGCAGCAGTGGGGAGCCGGACTGCTGAAG CCTAGCGAGAcACTGAGCCTGACCTGCGCCGTGTACGGC GGCAGCTTCAGCGGCTACTACTGGTCCTGGATCAGACAG AGCCCCGAGAAGGGCCTGGAATGGATCGGCGAGATCAAC CACGGCGGCTACGTGACCTACAACCCCAGCCTGGAAAGC AGAGTGACCATCAGCGTGGACACCAGCAAGAACCAGTTC AGCCTGAAGCTGAGCAGCGTGACAGCCGCCGACACAGCC GTGTACTACTGCGCCAGAGATTACGGCCCTGGCAACTACG ACTGGTACTTCGACCTGTGGGGCAGAGGCACCCTCGTGAC CGTGTCTAGCGCTTCCACAAAGGGCCCCAGCGTGTTCCCT CTGGCCCCTAGCAGCAAGAGCACATCTGGCGGAACAGCC GCCCTGGGCTGCCTCGTGAAGGACTACTTTCCCGAGCCCG TGACAGTGTCCTGGAACTCTGGCGCCCTGACAAGCGGCGT GCACACCTTTCCAGCCGTGCTGCAGAGCAGCGGCCTGTAC TCTCTGTCCAGCGTCGTGACTGTGCCCAGCAGCAGCCTGG GCACCCAGACCTACATCTGCAACGTGAACCACAAGCCCA GCAACACCAAGGTGGACAAGAAGGTGGAACCCAAGAGCT GCGACGGCGGAGGCGGATCTGGCGGCGGAGGATCCCAGG TGCAGCTGCAGCAGTGGGGCGCTGGCCTGCTGAAACCCT CTGAGACTCTGTCCCTGACATGTGCTGTGTATGGCGGCTC |

TABLE 7-continued

Sequences of bispecific, tetravalent anti-4-1BB/monovalent anti-FAP human IgG1 P329GLALA antigen binding molecules (Constructs with a-FAP VH fused to Fc hole chain and VL fused to Fc knob chain, termed hole-VH)

| SEQ ID NO: | Description | Sequence |
|---|---|---|
| | | CTTCTCCGGCTACTATTGGAGCTGGATTCGGCAGTCCCCT GAGAAAGGACTGGAATGGATTGGGGAAATCAATCATGGG GGATATGTGACATACAATCCCTCACTGGAATCCCGCGTGA CCATCTCCGTGGATACCTCTAAGAATCAGTTCTCTCTGAA GCTGTCCTCCGTGACCGCCGCTGATACCGCTGTGTATTAC TGTGCCCGGGACTACGGACCCGGCAATTATGATTGGTATT TTGATCTGTGGGGACGGGGCACACTCGTGACTGTGTCCTC TGCTAGCACCAAGGGCCCATCGGTCTTCCCCCTGGCACCC TCCTCCAAGAGCACCTCTGGGGGCACAGCGGCCCTGGGC TGCCTGGTCAAGGACTACTTCCCCGAACCGGTGACGGTGT CGTGGAACTCAGGCGCCCTGACCAGCGGCGTGCACACCT TCCCGGCTGTCCTACAGTCCTCAGGACTCTACTCCCTCAG CAGCGTGGTGACCGTGCCCTCCAGCAGCTTGGGCACCCA GACCTACATCTGCAACGTGAATCACAAGCCCAGCAACAC CAAGGTGGACAAGAAAGTTGAGCCCAAATCTTGTGACAA AACTCACACATGCCCACCGTGCCCAGCACCTGAAGCTGC AGGGGGACCGTCAGTCTTCCTCTTCCCCCCAAAACCCAAG GACACCCTCATGATCTCCCGGACCCCTGAGGTCACATGCG TGGTGGTGGACGTGAGCCACGAAGACCCTGAGGTCAAGT TCAACTGGTACGTGGACGGCGTGGAGGTGCATAATGCCA AGACAAAGCCGCGGGAGGAGCAGTACAACAGCACGTACC GTGTGGTCAGCGTCCTCACCGTCCTGCACCAGGACTGGCT GAATGGCAAGGAGTACAAGTGCAAGGTCTCCAACAAAGC CCTCGGCGCCCCCATCGAGAAAACCATCTCCAAAGCCAA AGGGCAGCCCCGAGAACCACAGGTGTACACCCTGCCCCC CTGCAGAGATGAGCTGACCAAGAACCAGGTGTCCCTGTG GTGTCTGGTCAAGGGCTTCTACCCCAGCGATATCGCCGTG GAGTGGGAGAGCAACGGCCAGCCTGAGAACAACTACAAG ACCACCCCCCCTGTGCTGGACAGCGACGGCAGCTTCTTCC TGTACTCCAAACTGACCGTGGACAAGAGCCGGTGGCAGC AGGGCAACGTGTTCAGCTGCAGCGTGATGCACGAGGCCC TGCACAACCACTACACCCAGAAGTCCCTGAGCCTGAGCC CCGGCGAGGCGGCGGAAGCGGAGGAGGAGGATCTGGG GGCGGAGGTTCCGGAGGCGGTGGATCTGAGATCGTGCTG ACCCAGTCTCCCGGCACCCTGTCTCTGAGCCCTGGCGAGA GAGCCACCCTGTCCTGCAGAGCCTCCCAGTCCGTGACCTC CTCCTACCTCGCCTGGTATCAGCAGAAGCCCGGCCAGGCC CCTCGGCTGCTGATCAACGTGGGCAGTCGGAGAGCCACC GGCATCCCTGACCGGTTCTCCGGCTCTGGCTCCGGCACCG ACTTCACCCTGACCATCTCCCGGCTGGAACCCGAGGACTT CGCCGTGTACTACTGCCAGCAGGGCATCATGCTGCCCCCC ACCTTTGGCCAGGGCACCAAGGTGGAAATCAAG |
| 43 | VLCL-Light chain (20H4.9) (nucleotide sequence) | see Table 1 |
| 61 | VHCH1-VHCH1 (20H4.9)-Heavy chain hole-VH (4B9) | QVQLQQWGAGLLKPSETLSLTCAVYGGSFSGYYWSWIRQS PEKGLEWIGEINHGGYVTYNPSLESRVTISVDTSKNQFSLKLS SVTAADTAVYYCARDYGPGNYDWYFDLWGRGTLVTVSSA STKGPSVFPLAPSSKSTSGGTAALGCLVKDYFPEPVTVSWNS GALTSGVHTFPAVLQSSGLYSLSSVVTVPSSSLGTQTYICNV NHKPSNTKVDKKVEPKSCDGGGSGGGGSQVQLQQWGAG LLKPSETLSLTCAVYGGSFSGYYWSWIRQSPEKGLEWIGEIN HGGYVTYNPSLESRVTISVDTSKNQFSLKLSSVTAADTAVY YCARDYGPGNYDWYFDLWGRGTLVTVSSASTKGPSVFPLA PSSKSTSGGTAALGCLVKDYFPEPVTVSWNSGALTSGVHTFP AVLQSSGLYSLSSVVTVPSSSLGTQTYICNVNHKPSNTKVDK KVEPKSCDKTHTCPPCPAPEAAGGPSVFLFPPKPKDTLMISR TPEVTCVVVDVSHEDPEVKFNWYVDGVEVHNAKTKPREEQ YNSTYRVVSVLTVLHQDWLNGKEYKCKVSNKALGAPIEKTI SKAKGQPREPQVCTLPPSRDELTKNQVSLSCAVKGFYPSDIA VEWESNGQPENNYKTTPPVLDSDGSFFLVSKLTVDKSRWQQ GNVFSCSVMHEALHNHYTQKSLSLSPGGGGSGGGGSGGG GSGGGGSEVQLLESGGGLVQPGGSLRLSCAASGFTFSSYAM SWVRQAPGKGLEWVSAIIGSGASTYYADSVKGRFTISRDNS KNTLYLQMNSLRAEDTAVYYCAKGWFGGFNYWGQGTLVT VSS |

TABLE 7-continued

Sequences of bispecific, tetravalent anti-4-1BB/monovalent anti-FAP human IgG1 P329GLALA antigen binding molecules (Constructs with a-FAP VH fused to Fc hole chain and VL fused to Fc knob chain, termed hole-VH)

| SEQ ID NO: | Description | Sequence |
|---|---|---|
| 62 | VHCH1-VHCH1 (20H4.9)-Heavy chain knob-VL (4B9) | QVQLQQWGAGLLKPSETLSLTCAVYGGSFSGYYWSWIRQS PEKGLEWIGEINHGGYVTYNPSLESRVTISVDTSKNQFSLKLS SVTAADTAVYYCARDYGPGNYDWYFDLWGRGTLVTVSSA STKGPSVFPLAPSSKSTSGGTAALGCLVKDYFPEPVTVSWNS GALTSGVHTFPAVLQSSGLYSLSSVVTVPSSSLGTQTYICNV NHKPSNTKVDKKVEPKSCDGGGGSGGGGSQVQLQQWGAG LLKPSETLSLTCAVYGGSFSGYYWSWIRQSPEKGLEWIGEIN HGGYVTYNPSLESRVTISVDTSKNQFSLKLSSVTAADTAVY YCARDYGPGNYDWYFDLWGRGTLVTVSSASTKGPSVFPLA PSSKSTSGGTAALGCLVKDYFPEPVTVSWNSGALTSGVHTFP AVLQSSGLYSLSSVVTVPSSSLGTQTYICNVNHKPSNTKVDK KVEPKSCDKTHTCPPCPAPEAAGGPSVFLFPPKPKDTLMISR TPEVTCVVVDVSHEDPEVKFNWYVDGVEVHNAKTKPREEQ YNSTYRVVSVLTVLHQDWLNGKEYKCKVSNKALGAPIEKTI SKAKGQPREPQVYTLPPCRDELTKNQVSLWCLVKGFYPSDI AVEWESNGQPENNYKTTPPVLDSDGSFFLYSKLTVDKSRWQ QGNVFSCSVMHEALHNHYTQKSLSLSPGGGGGSGGGGSGG GGSGGGGSEIVLTQSPGTLSLSPGERATLSCRASQSVTSSYLA WYQQKPGQAPRLLINVGSRRATGIPDRFSGSGSGTDFTLTIS RLEPEDFAVYYCQQGIMLPPTFGQGTKVEIK |
| 46 | VLCL-Light chain (20H4.9) | see Table 1 |

TABLE 8

Biochemical analysis of bispecific antigen binding molecules with a tetravalent binding to 4-1BB and a monovalent binding to FAP (4 + 1 4-1BB/FAP human IgG1 P329GLALA)

| Molecule | Monomer [%] | Yield [mg/l] | CE-SDS (non-red) |
|---|---|---|---|
| 4-1BB (20H4.9)/FAP (4B9) P329GLALA IgG1 4 + 1 (hole-VH) | 95.6 | 6 | 97.2 |

2.2 Binding of Bispecific Antibodies Targeting 4-1BB Tetravalent and FAP Monovalent (4+1 Antigen Binding Molecules)

2.2.1 Surface Plasmon Resonance (Simultaneous Binding)

The capacity of binding simultaneously human 4-1BB Fc(kih) and human FAP was assessed by surface plasmon resonance (SPR). All SPR experiments were performed on a Biacore T200 at 25° C. with HBS-EP as running buffer (0.01 M HEPES pH 7.4, 0.15 M NaCl, 3 mM EDTA, 0.005% Surfactant P20, Biacore, Freiburg/Germany).

Figure 5B:
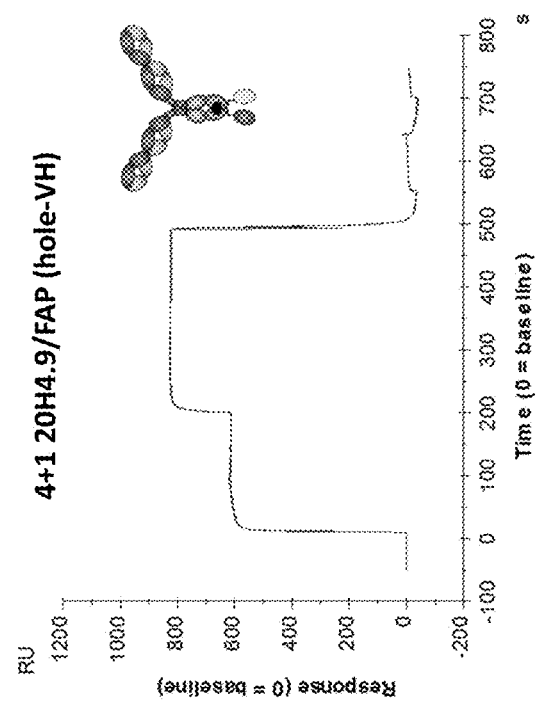
FIGS. 5A and 5B relate to the simultaneous binding of bispecific 4+1 anti-4-1BB/anti-FAP antigen binding molecules.
Figure 5A:
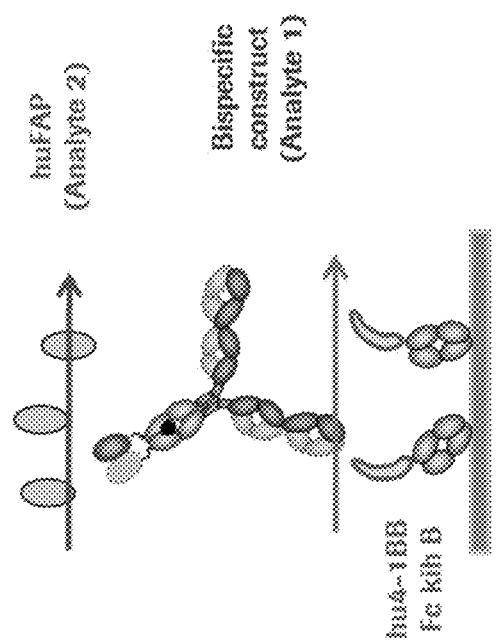

Biotinylated human 4-1BB Fc(kih) was directly coupled to a flow cell of a streptavidin (SA) sensor chip. Immobilization levels up to 400 resonance units (RU) were used. The bispecific antibodies targeting 4-1BB and FAP were passed at a concentration range of 200 nM with a flow of 30 µL/minute through the flow cells over 90 seconds and dissociation was set to zero sec. Human FAP was injected as second analyte with a flow of 30 µL/minute through the flow cells over 90 seconds at a concentration of 500 nM. The dissociation was monitored for 120 sec. Bulk refractive index differences were corrected for by subtracting the response obtained in a reference flow cell, where no protein was immobilized. All bispecific constructs could bind simultaneously human 4-1BB and human FAP (FIG. 5B).

Figure 6:
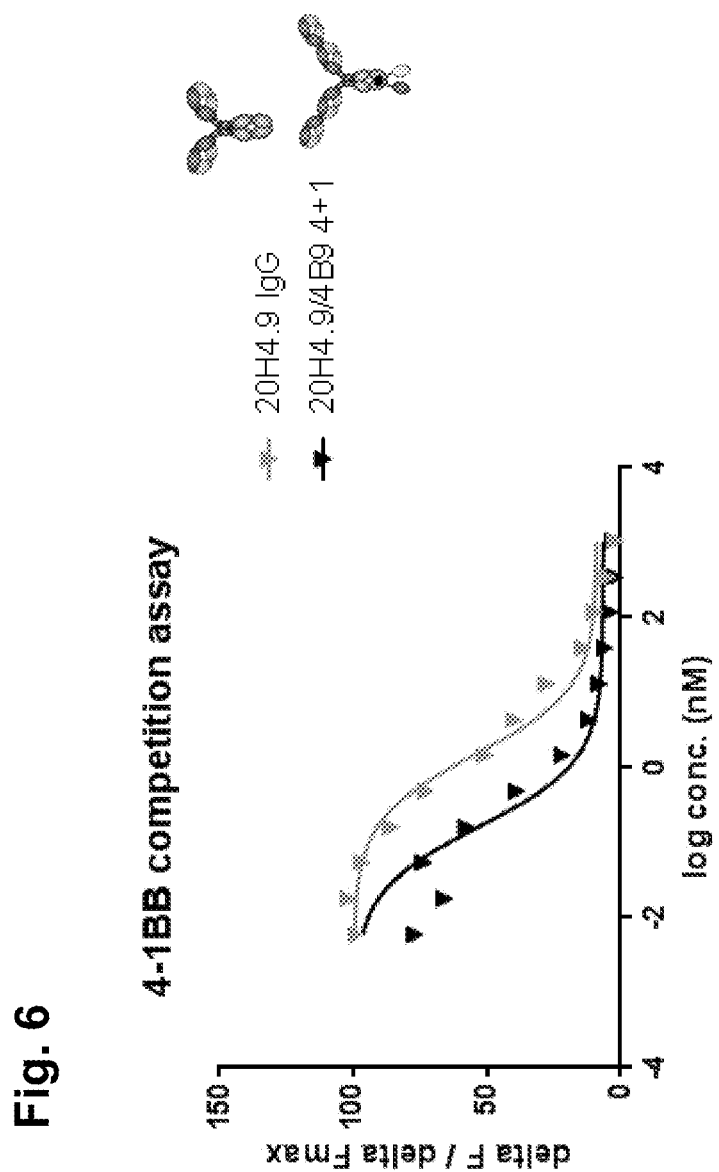
FIG. 6 shows a FRET based competition assay to assess the binding of the bivalent (IgG) anti-4-1BB (20H4.9) antibody and tetravalent (4+1) anti-4-1BB (20H4.9)/anti-FAP (4B9) antigen binding molecules to membrane bound 4-1BB. The bispecific, tetravalent (4+1) anti-4-1BB (20H4.9)/anti-FAP (4B9) antigen binding molecule competes better than the IgG counterpart.

2.3 Binding to Human 4-1BB—Competition Assay of Bivalent Vs Tetravalent Anti-4-1BB Constructs To confirm the ability of all four anti-4-1BB Fab domains to bind to hu4-1BB, a cell-based FRET assay (TagLite) was applied. Therefore, 2500 Hek293 EBNA cells/well transfected with a hu4-1BB-SNAP fusion and labeled with the FRET donor Terbium (Cisbio) were mixed with either 0.6 nM anti-4-1BB clone 20H4.9 IgG labeled with the FRET acceptor d2 (Cisbio). Additionally, a concentration dilution ranging from 0.006-1000 nM of the unlabeled anti-4-1-BB IgG (20H4.9), bivalent (20H4.9/4B9 2+1) or tetravalent (20H4.9/4B9 4+1) bispecific constructs was added and incubated for 2-4 hours at RT. The fluorescent signal was measured at 620 nm for the fluorescent donor (Terbium) and at 665 nm for the fluorescent acceptor dye (M100 Pro, Tecan). The ratio of 665/620*1000 was calculated, and the reference (cells only) was subtracted. For $EC_{50}$ determination the results were analysed in Graph Pad Prism6. The observed $EC_{50}$ values after 4 hour incubation are shown in Table 9. The tetravalent 4+1 20H4.9 antigen binding molecule competes better than the IgG counterpart (FIG. 6).

TABLE 9

$EC_{50}$ values for competitive binding of bivalent vs tetravalent 4-1BB binding molecules

| Molecule | $EC_{50}$ [nM] |
|---|---|
| 20H4.9 IgG | 1.5 (0.9-2.4) |
| 4-1BB(20H4.9)/FAP(4B9) 4 + 1 | 0.5 (0.3-0.7) |

2,4 Binding on Cells 2.4.1 Binding on Human 4-1BB Expressing Cells: Resting and Activated Human Peripheral Mononuclear Blood Leukocytes (PBMC)

Expression of human 4-1BB is absent on resting (naïve) human T cells (Kienzle G. and von Kempis J (2000), Int. Immunol. 12(1): 73-82, Wen T. et al. (2002), J. Immunol.

168, 4897-4906). After activation with immobilized anti-human CD3 agonistic antibody, 4-1BB is upregulated on $CD4^+$ and $CD8^+$ T cells. 4-1BB expression has also been reported on activated human NK cells (Baessler T. et. al. (2010) Blood 115(15), 3058-3069), activated human NKT cells (Cole S. L. et al. (2014) J. Immunol. 192(8), 3898-3907), activated human B cells (Zhang et al. (2010) J. Immunol. 184(2), 787-795), activated human eosinophils (Heinisch et al. 2001), constitutively on human neutrophils (Heinisch I. V. (2000) J Allergy Clin Immunol. 108(1), 21-28), activated human monocytes (Langstein J. et al. (1998) J Immunol. 160(5), 2488-2494, Kwajah M. and Schwarz H. (2010) Eur J Immunol. 40(7), 1938-1949), constitutively on human regulatory T cells (Bacher P. et al. (2014) Mucosal Immunol. 7(4), 916-928), human follicular dendritic cells (Pauly S. et al. (2002) J Leukoc Biol. 72(1), 35-42), activated human dendritic cells (Zhang L. et al. (2004) Cell Mol Immunol. 1(1), 71-76) and on blood vessels of malignant human tumors (Broll K. et al. (2001) Am J Clin Pathol. 115(4), 543-549).

To test binding of our anti-4-1BB antigen binding molecules to naturally cell-expressed human 4-1BB, resting peripheral blood mononuclear cells (PBMCs) or PHA-L/Proleukin pre-activated and CD3/CD28-reactivated PBMC were used. PBMCs from buffy coats obtained from the Zurich blood donation center were isolated by ficoll density centrifugation using Histopaque 1077 (SIGMA Life Science, Cat.-No. 10771, polysucrose and sodium diatrizoate, adjusted to a density of 1.077 g/mL) and resuspended in T cell medium consisting of RPMI 1640 medium (Gibco by Life Technology, Cat.-No. 42401-042) supplied with 10% Fetal Bovine Serum (FBS, Gibco by Life Technology, Cat.-No. 16000-044, Lot 941273, gamma-irradiated, *mycoplasma*-free and heat inactivated at 56° C. for 35 min), 1% (v/v) GlutaMAX-I (GIBCO by Life Technologies, Cat.-No. 35050 038), 1 mM Sodium Pyruvate (SIGMA, Cat.-No. S8636), 1% (v/v) MEM non-essential amino acids (SIGMA, Cat.-No. M7145) and 50 μM β-Mercaptoethanol (SIGMA, M3148). PBMCs were used directly after isolation (resting cells) or stimulated to induce 4-1BB expression at the cell surface of T cells by culturing for 3 to 5 days in T cell medium supplemented with 200 U/mL Proleukin (Novartis Pharma Schweiz AG, CHCLB-P-476-700-10340) and 2 μg/mL PHA-L (SIGMA Cat.-No. L2769) in a 6-well tissue culture plate and then 2 day in a 6-well tissue culture plate coated with 10 μg/mL anti-human CD3 (clone OKT3, BioLegend, Cat.-No. 317315) and 2 μg/mL anti-human CD28 (clone CD28.2, BioLegend, Cat.-No.: 302928) in T cell medium at 37° C. and 5% $CO_2$.

To determine binding to human 4-1BB expressed by human PBMCs, $0.1-0.2\times10^6$ freshly isolated e.g. resting or activated PBMCs were added to each well of a round-bottom suspension cell 96-well plates (Greiner bio-one, cellstar, Cat.-No. 650185). Plates were centrifuged 4 minutes with 400×g at 4° C. and supernatant was discarded. Cells were washed with 200 μL/well DPBS and then incubated for 30 min at 4° C. with 100 μL/mL DPBS containing 1:5000 diluted Fixable Viability Dye eFluor 660 (eBioscience, Cat.-No. 65-0864-18). Afterwards cells were washed once with 200 μL/well cold FACS buffer (DPBS supplied with 2% (v/v) FBS, 5 mM EDTA pH8 (Amresco, Cat. No. E177) and 7.5 mM sodium azide (Sigma-Aldrich S2002)). Next, 50 μL/well of 4° C. cold FACS buffer containing titrated bispecific FAP-targeted anti-human 4-1BB antibodies were added and cells were incubated for 120 minutes at 4° C. Cells were washed four times with 200 μL/well 4° C. FACS buffer to remove unbound molecules. Afterwards cells were further incubated with 50 μL/well of 4° C. cold FACS buffer containing 2.5 μg/mL PE-conjugated AffiniPure anti-human IgG Fcγ-fragment-specific goat F(ab')2 fragment (Jackson ImmunoResearch, Cat.-No. 109-116-098), anti-human CD45 AF488 (clone HI30, BioLegend, Cat.-No. 304019), 0.67 μg/mL PerCP/Cy5.5-conjugated anti-human CD3 mouse IgG1 κ (clone UCHT1, BioLegend, Cat.-No. 300430), 0.125 μg/mL BV421-conjugated anti-human CD4 moIgG1κ (clone RPA-T4, BioLegend, Cat.-No. 300532) or 0.23 μg/mL BV421-conjugated anti-human CD4 mouse IgG2b κ (clone OKT4, BioLegend, Cat.-No. 317434, 0.33 μg/mL anti-human CD8-BV510 (moIgG1κ, clone SK1, BioLegend, Cat.-No. 344732) and 0.67 μg/mL anti-human CD19-PE/Cy7 (moIgG1κ, clone HIB19, BioLegend, Cat.-No. 302216) and incubated for 30 minutes at 4° C. Cells were washed twice with 200 μL FACS buffer/well and fixated by resuspending in 50 μL/well DPBS containing 1% Formaldehyde (Sigma, HT501320-9.5L). Cells were acquired the same or next day using 3-laser MACSQuant Analyzer 10 (Miltenyi Biotech). Gates were set on $CD8^+$ and $CD4^+$ T cells and the geo mean of fluorescence intensity (MFI) of the secondary detection antibody was used to analyze binding of primary antibodies. Using Graph Pad Prism (Graph Pad Software Inc.) data was baselined by subtracting the blank values (no primary antibody added) and the EC50 values were calculated using non-linear regression curve fit (robust fit).

Human CD4 and CD8 T cells lack 4-1BB expression in a resting status but upregulate 4-1BB after activation Human $CD8^+$ T cells show a stronger up-regulation than $CD4^+$ T cells under the described activation conditions. The generated anti-human 4-1BB-specific antibodies can bind to human 4-1BB expressed by activated human T cells (FIGS. 7C and D) whereas on resting CD4 and CD8 T cells no significant binding can be detected (FIGS. 7A and B). Binding is influence by the 4-1BB expression level of the cells, e.g. 4-1BB-specific molecules bind stronger to activated CD8 T cells (FIG. 7D) than to activated CD4 T cells (FIG. 7C), and by the format, e.g. bivalent 4-1BB-binders (huIgG P329G LALA and 2+1 formats) bind differently than tetravalent 4-1BB-binder (4+1 format). Tetravalent 4-1BB-binding leads to a decreased MFI due to internal competition for 4-1BB-specific epitopes. No change is seen in the $EC_{50}$ (listed in Table 10), presumably due to method related limited sensitivity. The Taglite assay (FIG. 6) is more sensitive (no washing steps) and show clearly a difference in EC50 between bivalent and tetravalent 4-1BB-binding.

In FIGS. 8A and 8B the areas under the binding curve (AUC) are shown. A clear reduction of 4-1BB binding can be seen on activated CD8 T cells in following order: 4-1BB (20H4.9) huIgG1 P329G LALA>4-1BB (20H4.9)×FAP (4B9) 2+1>4-1BB (20H4.9)×FAP (4B9) 4+1. The fusion of a FAP-binding domain to the Fc-domain may hinder the binding of the polyclonal PE-conjugated AffiniPure anti-human IgG Fcγ-fragment-specific goat F(ab')2 fragment by masking epitopes and leads to a weaker detection. This may explain the drop of binding property between the 4-1BB (20H4.9) huIgG1 P329G LALA and 4-1BB (20H4.9)×FAP (4B9) 2+1 despite the fact, that both molecules display a bivalent 4-1BB binding side. The differences in AUC between 4-1BB (20H4.9)×FAP (4B9) 2+1>4-1BB (20H4.9)×FAP (4B9) 4+1 may be explained by internal competition for 4-1BB-specific epitopes as explained above.

TABLE 10

EC$_{50}$ values of binding curves to activated and 4-1BB-expressing human CD4$^+$ T cells and CD8$^+$ T cells determined via flow cytometry.

|  | 4-1BB (20H4.9) huIgG1 P329G LALA | 4-1BB (20H4.9) × FAP (4B9) 2 + 1 | 4-1BB (20H4.9) × FAP (4B9) 4 + 1 |
|---|---|---|---|
| EC$_{50}$ [nM] on activated CD4$^+$ T cells | 0.1 | 0.1 | 0.1 |
| EC$_{50}$ [nM] on activated CD8$^+$ T cells | 0.1 | 0.1 | 0.1 |

TABLE 11

EC$_{50}$ values and values of area under the curve (AUC) of binding to FAP expressing cell line NIH/3T3-huFAP clone 19 and WM-266-4

|  | 4-1BB (20H4.9) × FAP (4B9) 4 + 1 | 4-1BB (20H4.9) × FAP (4B9) 2 + 1 |
|---|---|---|
| EC$_{50}$ on WM-266-4 [nM] | 1.6 | 0.7 |
| EC$_{50}$ on NIH/3T3-huFAP clone 19 [nM] | 2 | 1.7 |
| AUC WM-266-4 | 4565 | 5424 |
| AUC NIH/3T3-huFAP clone 19 | 6793 | 8024 |

2.4.2 Binding to Human FAP-Expressing Cells

For binding to cell-surface-expressed human Fibroblast Activation Protein (FAP) NIH/3T3-huFAP clone 19 cells or human melanoma cell line WM-266-4 (ATCC CRL-1676) were used. NIH/3T3-huFAP clone 19 was generated by transfection of mouse embryonic fibroblast NIH/3T3 cells (ATCC CRL-1658) with the expression pETR4921 plasmid encoding human FAP under a CMV promoter. Cells were maintained in the presence of 1.5 µg/mL puromycin (InvivoGen, Cat.-No.: ant-pr-5). 2×10$^5$ of FAP expressing tumor cells were added to each well of a round-bottom suspension cell 96-well plates (Greiner bio-one, cellstar, Cat.-No. 650185). Cells were washed once with 200 µL DPBS and pellets were resuspended in 100 µL/well of 4° C. cold DPBS buffer containing 1:5000 diluted Fixable Viability Dye eFluor 450 (eBioscience, Cat. No. 65 0863 18) or Fixable Viability Dye eFluor 660 (eBioscience, Cat.-No. 65-0864-18). Plates were incubated for 30 minutes at 4° C. and washed once with 200 µL 4° C. cold DPBS buffer. Afterwards cells were resuspended in 50 µL/well of 4° C. cold FACS buffer containing different titrated concentrations of 4-1BB-specific FAP-targeted and non-targeted antibodies, followed by incubation for 1 hour at 4° C. After washing four times with 200 µL/well, cells were stained with 50 µL/well of 4° C. cold FACS buffer containing 2.5 µg/mL PE-conjugated AffiniPure anti-human IgG Fcγ-fragment-specific goat F(ab')2 fragment (Jackson ImmunoResearch, Cat.-No. 109-116-098) for 30 minutes at 4° C. Cells were washed twice with 200 µL 4° C. FACS buffer and then resuspended in 50 µL/well DPBS containing 1% Formaldehyde for fixation. The same or the next day cells were resuspended in 100 µL FACS-buffer and acquired using MACSQuant Analyzer 10 (Miltenyi Biotec).

As shown in FIG. 9, the FAP-targeted molecules, but not the non-FAP-targeted huIgG1 P293G LALA molecules bind efficiently to human FAP-expressing WM-266-4 (FIG. 9A) and NIH/3T3-huFAP clone 19 cells (FIG. 9B). Therefore including a FAP-binding side induces an efficient targeting effect to human FAP-expressing cells. EC$_{50}$ values of binding curves as well as the values under the curves are listed in Table 11.

2.5 NFκB Activation 2.5.1 Generation of HeLa Cells Expressing Human 4-1BB and NFκB-Luciferase The cervix carcinoma cell line HeLa (ATCC CCL-2) was transduced with a plasmid, based on the expression vector pETR10829, which contains the sequence of human 4-1BB (Uniprot accession Q07011) under control of a CMV-promoter and a puromycin resistance gene. Cells were cultured in DMEM medium supplemented with 10% (v/v) FBS, 1% (v/v) GlutaMAX-I and 3 µg/mL puromycin.

4-1BB-transduced HeLa cells were tested for 4-1BB expression by flow cytometry: 0.2×10$^6$ living cells were resuspended in 100 µL FACS buffer containing 0.1 µg PerCP/Cy5.5 conjugated anti-human 4-1BB mouse IgG1κ clone 4B4-1 (BioLegend Cat. No. 309814) or its isotype control (PerCP/Cy5.5 conjugated mouse IgG1κ isotype control antibody clone MOPC 21, BioLegend Cat. No. 400150) and incubated for 30 minutes at 4° C. Cells were washed twice with FACS buffer, resuspended in 300 µL FACS buffer containing 0.06 µg DAPI (Santa Cruz Biotec, Cat. No. Sc-3598) and acquired using a 5-laser LSR-Fortessa (BD Bioscience, DIVA software). Limited dilutions were performed to generate single clones as described: human-4-1BB-transduced HeLa cells were resuspended in medium to a density of 10, 5 and 2.5 cells/ml and 200 µl of cell suspensions were transferred to round bottom tissue-culture treated 96-well plates (6 plates/cell concentration, TPP Cat. No. 92697). Single clones were harvested, expanded and tested for 4-1BB expression as described above. The clone with the highest expression of 4-1BB (clone 5) was chosen for subsequent transfection with the NF-κB-luciferase expression-vector 5495p Tranlucent HygB. The vector confers transfected cells both with resistance to Hygromycin B and capacity to express luciferase under control of NF-kB-response element (Panomics, Cat. No. LR0051). For transfection Human-4-1BB HeLa clone 5 cells were cultured to 70% confluence. 50 µg (40 µL) linearized (restriction enzymes AseI and SalI) 5495p Tranlucent HygB expression vector were added to a sterile 0.4 cm Gene Pulser/Micro-Pulser Cuvette (Biorad, Cat.-No, 165-2081). 2.5×10$^6$ human-4-1BB HeLa clone 5 cells in 400 µl supplement-free DMEM medium were added and mixed carefully with the plasmid solution. Transfection of cells was performed using a Gene Pulser Xcell total system (Biorad, Cat No. 165 2660) under the following settings: exponential pulse, capacitance 500 µF, voltage 160 V, resistance 00 Immediately after the pulse transfected cells were transferred to a 75 cm$^2$ tissue culture flask (TPP, Cat. No. 90075) with 15 mL 37° C. warm DMEM medium supplied with 10% (v/v) FBS and 1% (v/v) GlutaMAX I. On the next day, culture medium containing 3 µg/mL Puromycin and 200 µg/mL Hygromycin B (Roche, Cat. No. 10843555001) was added. Surviving cells were expanded and limited dilution was performed as described above to generate single clones.

Clones were tested for 4-1BB expression as described above and for NF-κB-Luciferase activity as following: Clones were harvested in selection medium and counted using a Cell Counter Vi-cell xr 2.03 (Beckman Coulter, Cat. No. 731050). Cells were set to a cell density of $0.33 \times 10^6$ cells/mL and 150 μL of this cell suspension were transferred to each well of a sterile white 96-well flat bottom tissue culture plate with lid (greiner bio one, Cat. No. 655083). Cells were incubated at 37° C. and 5% $CO_2$ overnight in a cell incubator (Hera Cell). The next day 50 μL of medium containing different concentrations of recombinant human tumor necrosis factor alpha (rhTNFα, PeproTech, Cat.-No. 300 01A) were added to each well of a 96-well plate resulting in final concentration of rhTNFα of 100, 50, 25, 12.5, 6.25 and 0 ng/well. Cells were incubated for 6 hours at 37° C. and 5% $CO_2$ and then washed three times with 200 μL/well DPBS. Reporter Lysis Buffer (Promega, Cat-No: E3971) was added to each well (40 μl) and the plates were stored over night at −20° C. The next day frozen cell and Detection Buffer (Luciferase 1000 Assay System, Promega, Cat. No. E4550) were thawed to room temperature. 100 uL of detection buffer were added to each well and the plate was measured as fast as possible using a SpectraMax M5/M5e microplate reader and the SoftMax Pro Software (Molecular Devices). Measured units of released light for 500 ms/well (URLs) above control (no rhTNFα added) were taken as luciferase activity. The HeLa-hu4-1BB-NF-κB-luc clone 26 exhibiting the highest luciferase activity and a considerable level of 4-1BB-expression and was chosen for further use.

2.5.2 NFκB Activation in HeLa Expressing Human 4-1BB and Luciferase Reporter Cell Lines Co-Cultured with FAP-Expressing Tumor Cells HeLa-hu4-1BB-NF-κB-luc clone 26 cells were harvested and resuspended in DMEM medium supplied with 10% (v/v) FBS and 1% (v/v) GlutaMAX-I to a concentration of $0.2 \times 10^6$ cells/ml. 100 μl ($2 \times 10^4$ cells) of this cell suspension were transferred to each well of a sterile white 96-well flat bottom tissue culture plate with lid (greiner bio one, Cat. No. 655083) and the plate were incubated at 37° C. and 5% $CO_2$ overnight. The next day 50 μL of medium containing titrated FAP-targeted anti-human 4-1BB constructs or their parental huIgG1 P329G LALA antibodies were added. FAP-expressing NIH/3T3-huFAP clone 19 or WM-266-4 were resuspended in DMEM medium supplied with 10% (v/v) FBS and 1% (v/v) GlutaMAX-I to a concentration of $2 \times 10^6$ cells/ml.

Suspension of FAP-expressing tumor cell (50 μl) or medium as negative control was added to each well and plates were incubated for 6 hours at 37° C. and 5% $CO_2$ in the cell incubator. Cells were washed twice with 200 μL/well DPBS. 40 μl freshly prepared Reporter Lysis Buffer (Promega, Cat-No: E3971) were added to each well and the plate were stored over night at −20° C. The next day frozen cell plates and Detection Buffer (Luciferase 1000 Assay System, Promega, Cat. No. E4550) were thawed at room temperature. 100 μL of detection buffer were added to each well and luciferase activity was measured as fast as possible using a SpectraMax M5/M5e microplate reader and a SoftMax Pro Software (Molecular Devices).

In FIG. 10 the activation property of different FAP-targeted 4-1BB-specific constructs using a 4-1BB-expressing reporter cell line are shown. In FIG. 10A the activation property in the absence of FAP-expressing cells is shown. Only the molecule 4-1BB (20H4.9)×FAP (4B9) 4+1 (grey filled square) containing tetravalent 4-1BB binding sides can induce a strong activation. Molecules, containing only a bivalent 4-1BB binding side, fail to induce this strong activation showing, that 4-1BB-activation depends on a strong crosslinking of 4-1BB molecules on the surface of the effector cell. In the next blots FAP-expressing tumor cells were added in form of human melanoma cell line WM-266-4 which express an intermediate level of FAP (FIG. 10B) or the mouse fibrosoma cell line NIH/3T3 transfected, to express high level of human FAP (FIG. 10C). As soon as FAP-targeted molecules are crosslinked via this FAP-expressing tumor cells, the 4-1BB-binding sides lead to a strong crosslinking of 4-1BB on the reporter cell line surface and induce a strong activation of NKkB-mediated Luciferase expression. Independent of the moiety of 4-1BB-binding sides, the activation of 4-1BB (20H4.9)×FAP (4B9) 2+1 and 4-1BB (20H4.9)×FAP (4B9) 4+1 are quite similar. The only obvious difference between the 2+1 and 4+1 formats is seen in the absence of FAP-expressing tumor cells. The fitting area under the curve (AUC) are shown in FIG. 11 and the $EC_{50}$ values as are listed in Table 12.

TABLE 12

$EC_{50}$ values of activation of the NFκB signaling pathway in the presence of FAP-expressing cells

| $EC_{50}$ [nM] | 4-1BB (20H4.9) huIgG1 P329G LALA | 4-1BB (20H4.9) × FAP (4B9) 2 + 1 | 4-1BB (20H4.9) × FAP (4B9) 4 + 1 |
|---|---|---|---|
| no FAP⁺ cells | 1.07 | 0.73 | 0.13 |
| WM-266-4 | 0.64 | 0.08 | 0.05 |
| 3T3-huFAP | 2.17 | 0.07 | 0.04 |

2.6 Activation Assay of Human PBMCs in the Presence of FAP-Expressing Cells

For FAP-binding-mediated crosslinking of agonistic 4-1BB binder 20H4.9 the FAP-expressing adherent cell line NIH/3T3-huFAP clone 19 was used. NIH/3T3-huFAP clone 19 cells were washed with DPBS (Gibco by Life Technologies, Cat. No. 14190 326) and treated with enzyme-free, PBS-based Cell Dissociation Buffer (Gibco by Life Technologies, Cat.-No. 13151-014) for 10 minutes at 37° C. Cells were harvested and resuspended in T cell medium consisting of RPMI 1640 (GIBCO by Life Technologies, Cat.-No. 42401-042) supplied with 10% fetal bovine serum (FBS, US-origin, PAN biotech, P30-2009, Lot P150307GI, gamma irradiated *mycoplasma* free, heat inactivated 35 min 56° C.), 1% L-GlutaMAX-I (GIBCO by Life Technologies, Cat-No. 35050-038), 1 mM Sodium-Pyruvat (SIGMA-Aldrich, Cat.-No. 58636), 1% MEM-Non essential Aminoacid Solution (SIGMA-Aldrich, Cat.-No. M7145), 50 uM β-Mercaptoethanol (Sigma-Aldrich, Cyt.-No. M3148) and irradiated with 50 Gy (X-Ray Irradiator RS 2000, Rad source). $2 \times 10^4$ NIH/3T3-huFAP clone 19 cells in 50 μL T cell medium were seeded to each well of a round bottom tissue culture 96-well plate (TTP, Cat.-No. 92697). 50 μL of T cell medium containing different titrated concentrations of 4-1BB (20H4.9) huIgG1 P329G LALA, 4-1BB (20H4.9)×FAP (4B9) 2+1, 4-1BB (20H4.9)×FAP (4B9) 2+1 or control molecules 4-1BB (12B3)×FAP (4B9) 4+1 (as described in PCT patent application No. PCT/EP2016/073198) and DP47 huIgG1 P329G LALA were added respectively. Human PBMCs were labeled in 37° C. warm DPBS containing 40 nM CFDA-SE (SIGMA-Aldrich, Cat.-No. 21888-25MG-F) for 15 min at 37° C. CFSE-labeling was stopped by adding FBS, PBMCs were washed twice and resuspended in T cell medium to a final concentration of $1.5 \times 10^6$ cells/mL. 50 μL of this PBMC cell solution were seeded to each well to add $7.5 \times 10^4$ CFSE-labeled PBMCs well. Finally a stock solution of T cell medium containing 2 mM agonistic anti-human CD3 human IgG1 clone V9 was prepared and 50 μL/well were added to each well giving a final concentration of 0.5 mM anti-human CD3 human IgG1 clone V9.

Plates were incubated for 4 days at 37° C. Cells were washed with DPBS and stained with 100 μL/well DPBS containing 1:1000 diluted LIVE/DEAD Fixable Aqua Dead Cell Stain Kit (Molecular Probes by Life Technology, Cat.-No. L34957) for 30 min at 4° C. Cells were washed once with 200 μL/well DPBS and stained with 50 μL FACS buffer (DPBS supplied with 2% FBS, 5 mM EDTA pH8 (Amresco, Cat. No. E177) and 7.5 mM Sodium azide (Sigma-Aldrich S2002)) containing 0.1 μg/mL PerCP-Cy5.5-conjugated anti-human CD137 mouse IgG1 κ (clone 4B4-1, BioLegend, Cat.-No. 309814), 0.1 μg/mL PE/Cy7-conjugated anti-human PD-1 mouse IgG1 κ (clone EH12.2H7, BioLegend, Cat.-No. 329918), 0.03 μg/mL APC-conjugated anti-human CD25 mouse IgG1 κ (clone BC96, BioLegend, Cat.-No. 302610), 0.06 μg/mL APC/Cy7-conjugated anti-human CD8 Mouse IgG1 κ (clone RPA-T8, BioLegend, Cat.-No. 3301016), BV421-conjugated anti-human CD4 Mouse IgG1 κ (clone RPA-T4, BioLegend, Cat.-No. 300532) for 30 mM at 4° C. Cells were washed twice with 200 μL/well DPBS and incubated for 30 min at 4° C. with 50 μL/well freshly prepared FoxP3 Perm/Fix buffer (eBioscience Cat.-No. 00-5123). Cells were washed twice with 200 μL/well DPBS, resuspended in 50 μL/well freshly prepared Perm-buffer (eBioscience Cat.-No. 00-8333) supplied with PE-conjugated 1:250 diluted anti-human Granzyme B mouse IgG1 κ (clone GB11, Lot 4269803, BD Pharmingen, Cat.-No. 561142) and incubated for 1 h at 4° C. Plates were washed twice with 200 μL/well DPBS and cells were fixed for 15 min with DPBS containing 1% Formaldehyde (Sigma, HT501320-9.5L). Cells were resuspended in 100 μL/well FACS-buffer and acquired using the MACS Quant Analyzer 10 (Miltenyi Biotech). Data was analyzed using FlowJo V10 (FlowJo, LLC) and GraphPad Prism 6.04 (GraphPad Software, Inc).

As shown in FIG. 12, the FAP-targeted agonistic 4-1BB (20H4.9) 2+1 and 4+1 antigen binding molecules are able to induce upregulation of CD25 as well as improved proliferation of CD4 and CD8 T cells in the presence of a suboptimal CD3 stimulus. Both molecules show better effects than the molecule 4-1BB (12B3)×FAP (4B9) 4+1, which has been added as positive control and has been described before in PCT patent application No. PCT/EP2016/073198. Therefore, in the presence of FAP-expressing cells and a suboptimal TCR-stimulus FAP-targeted 4-1BB (20H4.9) agonist can induce T cell activation and proliferation independent of its format e.g. the 4+1 bispecific antigen binding molecule is not more efficient than the 2+1 bispecific antigen binding molecule.

In FIG. 13 the area under the curve (AUC) values of the curves in FIG. 12 are shown. As baseline activation the AUC of the control molecule (untargeted DP47 huIgG1 P329G LALA) is shown. The fitting $EC_{50}$ values are listed in Table 13.

TABLE 13

$EC_{50}$ values of human PBMC activation curves

| $EC_{50}$ [nM] | huIgG1 4-1BB (20H4.9) P329G LALA | 4-1BB (20H4.9) × FAP (4B9) 2+1 | 4-1BB (20H4.9) × FAP (4B9) 4+1 | 4-1BB (12B3) × FAP (4B9) 4+1 |
|---|---|---|---|---|
| % CD25 + CD4 | 0.1 | 0.005 | 0.006 | 0.009 |
| % CD25 + CD8 | n.d. | 0.02 | 0.009 | 0.012 |
| % proliferating CD4 | 0.07 | 0.004 | 0.003 | 0.008 |
| % proliferating CD8 | n.d. | 0.001 | 0.002 | 0.0001 |

Example 3

Figure 1E:
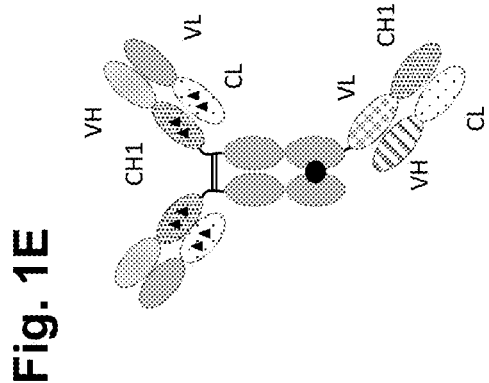
FIGS. 1D and 1E show the bispecific antigen binding molecule in huIgG1 P329GLALA format comprising two anti-4-1BB Fab fragments (bivalent binding to-4-1BB) and a cross-fab capable of specific binding to a target cell antigen, for example anti-FAP, anti-CEA or anti-CD19, fused at the C-terminus of one of the heavy chains. This format is termed 2+1 crossfab format.
Figure 1D:
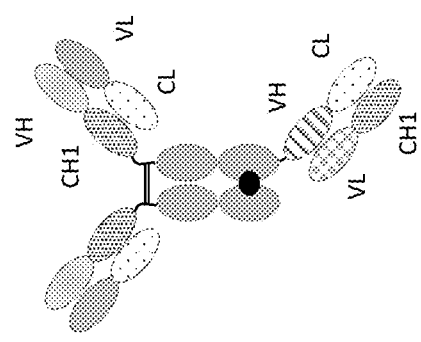
Figure 1C:
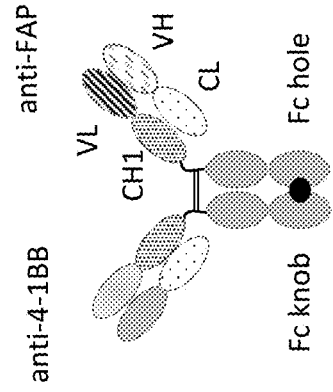
FIG. 1C shows the bispecific monovalent anti-4-1BB and monovalent anti-FAP antigen binding molecule (huIgG1 P329G LALA), termed also 1+1 format. The anti-FAP is a crossover fab, meaning that the heavy chain comprises VL-CH1, whereas the light chain comprises VH-CL, and the anti-4-1BB is a fab with charged variants.

Preparation, Purification and Characterization of Bispecific Antibodies with a Monovalent Binding to 4-1BB and Monovalent Binding to FAP 3.1 Generation of Bispecific Antibodies with a Monovalent Binding to 4-1BB and a Monovalent Binding to FAP Bispecific agonistic 4-1BB antibodies with monovalent binding for 4-1BB and monovalent binding for FAP, also termed 1+1, were prepared as depicted in FIG. 1C. The knobs into hole technology was applied by introducing the S354C/T366W mutations in the first heavy chain HC1 (Fc knob heavy chain) and introducing the Y349C/T366S/L368A/Y407V mutations in the second heavy chain HC2 (Fc hole heavy chain) to allow generation of a heterodimer.

In this example the first heavy chain HC1 of the construct was comprised of the following components: VHCH1 of an anti-4-1BB (clone 20H4.9) followed by Fc knob. The second heavy chain HC2 was comprised of VLCH1 of anti-FAP (clone 4B9) followed by Fc hole. To improve correct pairing the following mutations (charged variants) have been introduced in the CH-CL of the anti-4-1BB (Fc knob chain): E123R and Q124K in CL and K147E and K213E in CH1. For the 4-1BB binder, the VH and VL sequences of clone 20H4.9 were obtained from U.S. Pat. No. 7,659,384(B2). Combination of the Fc knob with the Fc hole chain allowed the generation of a heterodimer, which includes one FAP binding Fab and one 4-1BB binding Fab.

The Pro329Gly, Leu234Ala and Leu235Ala mutations were introduced in the constant region of the knob and hole heavy chains to abrogate binding to Fc gamma receptors according to the method described in International Patent Appl. Publ. No. WO2012/130831A1.

The amino acid sequences for 1+1 anti-4-1BB, anti-FAP huIgG1 PGLALA can be found in Table 14.

TABLE 14

Sequences of bispecific, monovalent anti-4-1BB/monovalent anti-FAP human IgG1 P329GLALA antigen binding molecules

| SEQ ID NO: | Description | Sequence |
|---|---|---|
| 124 | VHCH1(EE) 4-1BB(20H4.9)-Heavy chain knob | QVQLQQWGAGLLKPSETLSLTCAVYGGSFSGYYWSWIRQS PEKGLEWIGEINHGGYVTYNPSLESRVTISVDTSKNQFSLKLS SVTAADTAVYYCARDYGPGNYDWYFDLWGRGTLVTVSSA STKGPSVFPLAPSSKSTSGGTAALGCLVEDYFPEPVTVSWNS GALTSGVHTFPAVLQSSGLYSLSSVVTVPSSSLGTQTYICNV NHKPSNTKVDEKVEPKSCDKTHTCPPCPAPEAAGGPSVFLFP PKPKDTLMISRTPEVTCVVVDVSHEDPEVKFNWYVDGVEV HNAKTKPREEQYNSTYRVVSVLTVLHQDWLNGKEYKCKVS NKALGAPIEKTISKAKGQPREPQVYTLPPCRDELTKNQVSLW CLVKGFYPSDIAVEWESNGQPENNYKTTPPVLDSDGSFFLYS KLTVDKSRWQQGNVFSCSVMHEALHNHYTQKSLSLSPGK |
| 125 | VLCH1 FAP (4B9)-Heavy chain hole | EIVLTQSPGTLSLSPGERATLSCRASQSVTSSYLAWYQQKPG QAPRLLINVGSRRATGIPDRFSGSGSGTDFTLTISRLEPEDFA VYYCQQGIMLPPTFGQGTKVEIKSSASTKGPSVFPLAPSSKST SGGTAALGCLVKDYFPEPVTVSWNSGALTSGVHTFPAVLQS SGLYSLSSVVTVPSSSLGTQTYICNVNHKPSNTKVDKKVEPK SCDKTHTCPPCPAPEAAGGPSVFLFPPKPKDTLMISRTPEVTC VVVDVSHEDPEVKFNWYVDGVEVHNAKTKPREEQYNSTY RVVSVLTVLHQDWLNGKEYKCKVSNKALGAPIEKTISKAK GQPREPQVCTLPPSRDELTKNQVSLSCAVKGFYPSDIAVEWE SNGQPENNYKTTPPVLDSDGSFFLVSKLTVDKSRWQQGNVF SCSVMHEALHNHYTQKSLSLSPGK |
| 126 | VLCL(RK)-Light chain 4-1BB (20H4.9) | EIVLTQSPATLSLSPGERATLSCRASQSVSSYLAWYQQKPGQ APRLLIYDASNRATGIPARFSGSGSGTDFTLTISSLEPEDFAVY YCQQRSNWPPALTFGGGTKVEIKRTVAAPSVFIFPPSDRKLK SGTASVVCLLNNFYPREAKVQWKVDNALQSGNSQESVTEQ DSKDSTYSLSSTLTLSKADYEKHKVYACEVTHQGLSSPVTK SFNRGEC |
| 127 | VHCL-Light chain FAP(4B9) | EVQLLESGGGLVQPGGSLRLSCAASGFTFSSYAMSWVRQAP GKGLEWVSAIIGSGASTYYADSVKGRFTISRDNSKNTLYLQ MNSLRAEDTAVYYCAKGWFGGFNYWGQGTLVTVSSASVA APSVFIFPPSDEQLKSGTASVVCLLNNFYPREAKVQWKVDN ALQSGNSQESVTEQDSKDSTYSLSSTLTLSKADYEKHKVYA CEVTHQGLSSPVTKSFNRGEC |

The bispecific 1+1 anti-4-1BB, anti-FAP huIgG1 PGLALA was produced by co-transfecting CHO-K1 cells growing in suspension with the mammalian expression vectors using eviFect (Evitria AG). The cells were transfected with the corresponding expression vectors in a 1:1:1:1 ratio ("vector knob heavy chain": "vector hole heavy chain": "vector light chain 1": "vector light chain 2").

For transfection CHO-K1 cells are cultivated in suspension serum free in eviMake (Evitria AG) culture medium. After 7 days at 37° C. in an incubator with a 5% $CO_2$ atmosphere, cultivation supernatant is collected for purification by centrifugation and the solution is sterile filtered (0.22 μm filter) and kept at 4° C.

Secreted proteins were purified from cell culture supernatants by affinity chromatography using Protein A, followed by size exclusion chromatography. For affinity chromatography, the supernatant was loaded on a Protein A MabSelectSure column (CV=5 mL, GE Healthcare) equilibrated with 40 mL 20 mM sodium phosphate, 20 mM sodium citrate pH 7.5. Unbound protein was removed by washing with at least 10 column volumes of 20 mM sodium phosphate, 20 mM sodium citrate containing buffer (pH 7.5). The bound protein was eluted using a linear pH-gradient of sodium chloride (from 20 to 100 mM) created over 15 column volumes of 20 mM sodium citrate, 100 mM sodium chloride, 100 mM glycine, pH 3.0. The column was then washed with 10 column volumes of 20 mM sodium citrate, 100 mM NaCl, 100 mM Glycine, pH 3.0. The pH of collected fractions was adjusted by adding ¹/₄₀ (v/v) of 2M Tris, pH8.0. The protein was concentrated and filtered prior to loading on a HiLoad Superdex 16/600 S200 column (GE Healthcare) equilibrated with 20 mM histidine, 140 mM sodium chloride, pH 6.0.

The protein concentration of purified bispecific constructs was determined by measuring the OD at 280 nm, using the molar extinction coefficient calculated on the basis of the amino acid sequence. Purity and molecular weight of the bispecific constructs were analyzed by CE-SDS in the presence and absence of a reducing agent (Invitrogen, USA) using a LabChipGXII (Caliper). The aggregate content of bispecific constructs was analyzed using a TSKgel G3000 SW XL analytical size-exclusion column (Tosoh) equilibrated in a 25 mM $K_2HPO_4$, 125 mM NaCl, 200 mM L-Arginine Monohydrocloride, 0.02% (w/v) $NaN_3$, pH 6.7 running buffer at 25° C.

TABLE 15

Biochemical analysis of bispecific antigen binding molecules with a monovalent binding to 4-1BB and a monovalent binding to FAP (1 + 1 4-1BB/FAP human IgG1 P329GLALA)

| Molecule | Monomer [%] | Yield [mg/l] | CE-SDS (non-red) |
|---|---|---|---|
| 4-1BB (20H4.9)/FAP (4B9) P329GLALA IgG1 1 + 1 | 99 | 120 | 99 |

3.2 Functional In Vitro Characterization: Ability to Induce NFκB Activation Via 4-1BB and FAP Simultaneously Binding 3.2.1 Generation of HeLa Cells Expressing Human 4-1BB and NFκB-Luciferase The cervix carcinoma cell line HeLa (ATCC CCL-2) was transduced with a plasmid, based on the expression vector pETR10829, which contains the sequence of human 4-1BB (Uniprot accession Q07011) under control of a CMV-promoter and a puromycin resistance gene. Cells were cultured in DMEM medium supplemented with 10% (v/v) FBS, 1% (v/v) GlutaMAX-I and 3 µg/mL puromycin.

4-1BB-transduced HeLa cells were tested for 4-1BB expression by flow cytometry: $0.2 \times 10^6$ living cells were resuspended in 100 µL FACS buffer containing 0.1 µg PerCP/Cy5.5 conjugated anti-human 4-1BB mouse IgG1κ clone 4B4-1 (BioLegend Cat. No. 309814) or its isotype control (PerCP/Cy5.5 conjugated mouse IgG1κ isotype control antibody clone MOPC 21, BioLegend Cat. No. 400150) and incubated for 30 minutes at 4° C. Cells were washed twice with FACS buffer, resuspended in 300 µL FACS buffer containing 0.06 µg DAPI (Santa Cruz Biotec, Cat. No. Sc-3598) and acquired using a 5-laser LSR-Fortessa (BD Bioscience, DIVA software). Limited dilutions were performed to generate single clones as described: human-4-1BB-transduced HeLa cells were resuspended in medium to a density of 10, 5 and 2.5 cells/ml and 200 µl of cell suspensions were transferred to round bottom tissue-culture treated 96-well plates (6 plates/cell concentration, TPP Cat. No. 92697). Single clones were harvested, expanded and tested for 4-1BB expression as described above. The clone with the highest expression of 4-1BB (clone 5) was chosen for subsequent transfection with the NFκB-luciferase expression-vector 5495p Tranlucent HygB. The vector confers transfected cells both with resistance to Hygromycin B and capacity to express luciferase under control of NFκB-response element (Panomics, Cat. No. LR0051). For transfection Human-4-1BB HeLa clone 5 cells were cultured to 70% confluence. 50 µg (40 µL) linearized (restriction enzymes AseI and SalI) 5495p Tranlucent HygB expression vector were added to a sterile 0.4 cm Gene Pulser/Micro-Pulser Cuvette (Biorad, Cat.-No, 165-2081). $2.5 \times 10^6$ human-4-1BB HeLa clone 5 cells in 400 µl supplement-free DMEM medium were added and mixed carefully with the plasmid solution. Transfection of cells was performed using a Gene Pulser Xcell total system (Biorad, Cat No. 165 2660) under the following settings: exponential pulse, capacitance 500 µF, voltage 160 V, resistance unlimited. Immediately after the pulse transfected cells were transferred to a 75 cm² tissue culture flask (TPP, Cat. No. 90075) with 15 mL 37° C. warm DMEM medium supplied with 10% (v/v) FBS and 1% (v/v) GlutaMAX-I. On the next day, culture medium containing 3 µg/mL Puromycin and 200m/mL Hygromycin B (Roche, Cat. No. 10843555001) was added. Surviving cells were expanded and limited dilution was performed as described above to generate single clones.

Clones were tested for 4-1BB expression as described above and for NFκB-Luciferase activity as following: Clones were harvested in selection medium and counted using a Cell Counter Vi-cell xr 2.03 (Beckman Coulter, Cat. No. 731050). Cells were set to a cell density of $0.33 \times 10^6$ cells/mL and 150 µL of this cell suspension were transferred to each well of a sterile white 96-well flat bottom tissue culture plate with lid (greiner bio one, Cat. No. 655083). Cells were incubated at 37° C. and 5% $CO_2$ overnight in a cell incubator (Hera Cell). The next day 50 µL of medium containing different concentrations of recombinant human tumor necrosis factor alpha (rhTNFα, PeproTech, Cat.-No. 300 01A) were added to each well of a 96-well plate resulting in final concentration of rhTNFα of 100, 50, 25, 12.5, 6.25 and 0 ng/well. Cells were incubated for 6 hours at 37° C. and 5% $CO_2$ and then washed with 200 µL/well DPBS. Reporter Lysis Buffer (Promega, Cat-No: E3971) was added to each well (40 µL) and the plates were stored over night at −20° C. The next day frozen cell plates and Detection Buffer (Luciferase 1000 Assay System, Promega, Cat. No. E4550) were thawed to room temperature. 100 uL of detection buffer were added to each well and the plate was measured as fast as possible using a SpectraMax M5/M5e microplate reader and the SoftMax Pro Software (Molecular Devices). Measured units of released light for 500 ms/well (URLs) above control (no rhTNFα added) were taken as luciferase activity. The HeLa-hu4-1BB-NFκB-luc clone 26 exhibiting the highest luciferase activity and a considerable level of 4-1BB-expression and was chosen for further use.

3.2.2 NFκB Activation in HeLa Cells Expressing Human 4-1BB Reporter Cell Lines Co-Cultured with FAP-Expressing Tumor Cells HeLa-hu4-1BB-NFκB-luc clone 26 cells were harvested and resuspended in DMEM medium supplied with 10% (v/v) FBS and 1% (v/v) GlutaMAX-I to a concentration of $0.2 \times 10^6$ cells/mL. 100 µl ($2 \times 10^4$ cells) of this cell suspension were transferred to each well of a sterile white 96-well flat bottom tissue culture plate with lid (greiner bio one, Cat. No. 655083) and the plate were incubated at 37° C. and 5% $CO_2$ overnight. The next day 50 µL of medium containing titrated concentrations of 4-1BB (20H4.9)×FAP (4B9) 1+1, 4-1BB (20H4.9) huIgG4, 4-1BB (20H4.9) huIgG1 P329G LALA or untargeted DP47 huIgG1 P329G LALA were added. FAP-expressing human melanoma cell line WM-266-4 (ATCC CRL-1676) were resuspended in DMEM medium supplied with 10% (v/v) FBS and 1% (v/v) GlutaMAX-I to a concentration of $2 \times 10^6$ cells/ml. Suspension of FAP-expressing WM-266-4 cells (50 µl) or medium as negative control was added to each well and plates were incubated for 6 hours at 37° C. and 5% $CO_2$ in the cell incubator. Cells were washed with 200 µL/well DPBS. 40 µL freshly prepared Reporter Lysis Buffer (Promega, Cat-No: E3971) were added to each well and the plates were stored over night at −20° C. The next day frozen cell plates and Detection Buffer (Luciferase 1000 Assay System, Promega, Cat. No. E4550) were thawed at room temperature. 100 µL of detection buffer were added to each well and luciferase activity was measured as fast as possible using a SpectraMax M5/M5e microplate reader and a SoftMax Pro Software (Molecular Devices).

Figures 10D, 10E:
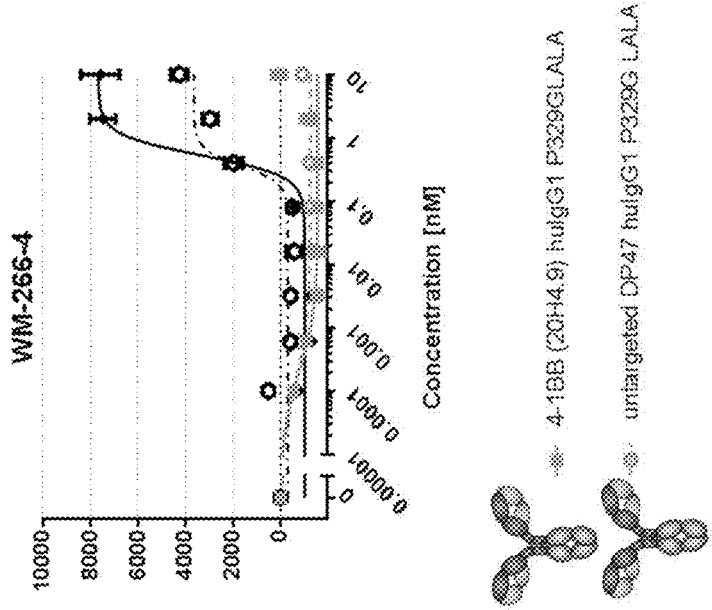
FIGS. 10D and 10E shows the NFκB-mediated luciferase expression activity in 4-1BB expressing reporter cell line HeLa-hu4-1BB-NFκB-luc. The concentration of FAP-targeted agonistic 4-1BB-binding construct 4-1BB (20H4.9)×FAP (4B9) 1+1 (black diamonds) or its controls are blotted against the units of released light (URLs) measured after 6 h of incubation. All values are baseline corrected by subtracting the baseline values of the blank control (e.g. no antibodies added).
Figure 12A:
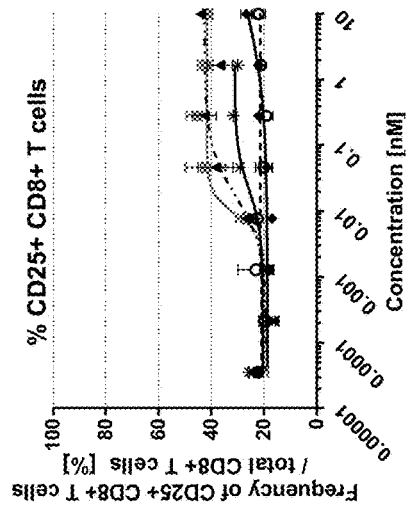
In FIGS. 12A to 12D human PBMC activation in the presence of human FAP-expressing fibroblast cell line (NIH/3T3-huFAP) is shown. Incubation of fresh isolated human PBMCs in the presence of FAP-expressing cells and a CD3 stimulus leads to a upregulation of CD25 on CD4$^+$ T cells (FIG. 12A) and CD8$^+$ T cells (FIG. 12B) as well as to an increased proliferation of CD4$^+$ T cells (FIG. 12C) and CD8$^+$ T cells (FIG. 12D) if FAP-targeted 4-1BB (20H4.9) antigen binding molecules (black filled triangle and dotted line and filled grey square) or the bispecific antigen binding molecule 4-1BB (12B3)×FAP (4B9) 4+1 (black stars, positive control molecule with another anti-4-1BB clone) are present. Independent of the targeting-ratio (4+1 versus 2+1) both bispecific antigen binding molecules with the 4-1BB binder clone 20H4.9 are able to induce similar activation of the CD4 and CD8 T cells, whereas the bispecific antigen binding molecule comprising the 4-1BB binder 12B3 leads to less activation potency. The non-FAP-targeted 4-1BB (20H4.9) huIgG1 P329G LALA molecule (filled black diamond) is only able to increase activation and proliferation of CD4 T cells to a certain extent.
Figure 12C:
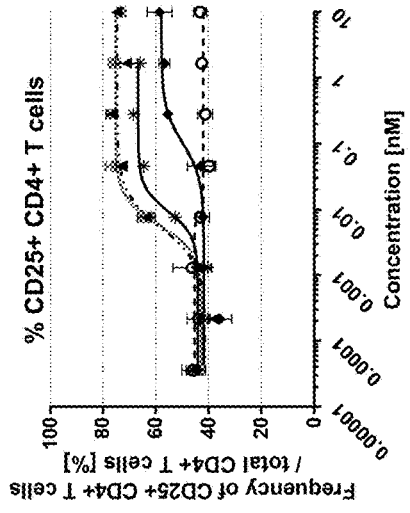
Figure 12B:
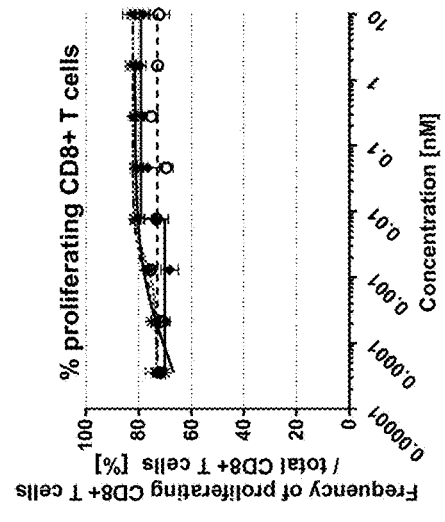
Figure 12D:
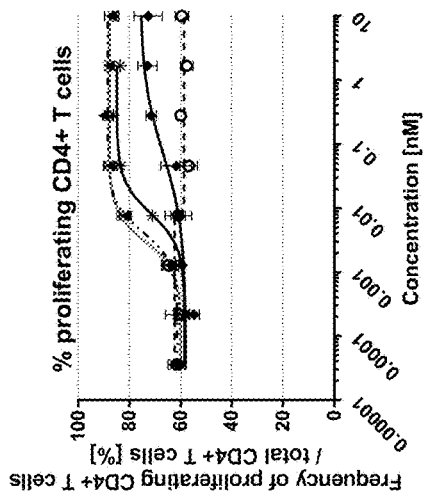

In FIGS. 10D and 10E the activation property of 4-1BB (20H4.9)×FAP (4B9) 1+1 (black filled diamond), 4-1BB (20H4.9) huIgG4 (open black hexagon, dotted line), 4-1BB (20H4.9) huIgG1 P329G LALA (filled grey square) or untargeted DP47 huIgG1 P329G LALA (ope grey circle, dotted line) using a 4-1BB-expressing reporter cell line is shown. In FIG. 10D the activation property in the absence of FAP-expressing WM-266-4 and in FIG. 10E in the presence of WM-266-4 cells were tested. In the absence of any crosslinking the activation is only seen for 4-1BB (20H4.9) huIgG4 (open black hexagon) and to a lesser extend for 4-1BB (20H4.9) huIgG1 P329G LALA (filled grey square) containing an inert FcγR-binding Fc-part. In the presence of FAP-crosslinking 4-1BB (20H4.9)×FAP (4B9) 1+1 (black diamond) shows the strongest activation potential due to its ability of simultaneously binding and therefore FAP-mediated crosslinking of 4-1BB receptors on the surface of the reporter cell line HeLa-hu4-1BB-NFκB-Luc clone 26 cells. $EC_{50}$ values and area under the curves (AUC) are listed in Table 16 and AUC values are as well shown in FIGS. 11A to 11C.

TABLE 16

EC$_{50}$ values and area under the curve (AUC) of activation of the NFκB signaling pathway in the presence of FAP-expressing tumor cells

|  | 4-1BB (20H4.9) huIgG4 | 4-1BB (20H4.9) × FAP (4B9) 1 + 1 | 4-1BB (20H4.9) huIgG1 P329G LALA | untargeted DP47 huIgG1 P329G LALA |
|---|---|---|---|---|
| no cells EC$_{50}$ as mean (SD) in nM | 0.33 (0.003) | n.d. | 1.26 (0.96) | n.d. |
| WM-266-4 EC$_{50}$ as mean (SD) in nM | 1.06 (0.79) | 0.50 (0.12) | n.d. | n.d. |
| no cells AUC as mean (SD) | 10581 (1069) | 4453 (1356) | 4279 (281) | 5375 (149) |
| WM-266-4 AUC as mean (SD) | 6108 (896) | 12451 (718) | 6269 (1206) | 5880 (502) |

Example 4

Preparation, Purification and Characterization of Bispecific Antigen Binding Molecules with a Bivalent Binding to 4-1BB and an Untargeted VH and VL Moiety (Control Molecules)

4.1 Generation of Bispecific Antibodies with a Bivalent Binding to 4-1BB and an Untargeted VH and VL Moiety (DP47 Germline Control)

Bispecific agonistic 4-1BB antibodies with bivalent binding for 4-1BB and containing an untargeted (DP47) VH and VL moiety were prepared similarly to the 2+1 format in Example 1, and as depicted in FIGS. 1A and 1B.

In this example the first heavy chain HC1 of the construct was comprised of the following components: VHCH1 of an anti-4-1BB (clone 20H4.9) followed by Fc hole, at which C-terminus a VL, or a VH, of a non binding clone (DP47) was fused. The second heavy chain HC2 was comprised of VHCH1 of anti-4-1BB (clone 20H4.9) followed by Fc knob, at which C-terminus a VH, or a VL, of a non binding clone (DP47) was fused. For the 4-1BB binder, the VH and VL sequences of clone 20H4.9 were obtained from U.S. Pat. No. 7,659,384(B2). Combination of the Fc knob with the Fc hole chain allows generation of a heterodimer, which includes a non binding moiety (DP47) and two 4-1BB binding Fabs (FIGS. 1A and 1B).

The Pro329Gly, Leu234Ala and Leu235Ala mutations were introduced in the constant region of the knob and hole heavy chains to abrogate binding to Fcgamma receptors according to the method described in International Patent Appl. Publ. No. WO2012/130831A1.

The amino acid sequences for 2+1 anti-4-1BB, untargeted (DP47) VH fused to knob and VL fused to hole chain can be found respectively in Table 17. The amino acid sequences for 2+1 anti-4-1BB, untargeted (DP47) VL fused to knob and VH fused to hole chain can be found in Table 18, respectively.

TABLE 17

Sequences of bispecific, bivalent anti-4-1BB/untargeted DP47 human IgG1 P329GLALA antigen binding molecules (Constructs with DP47 VL fused to Fc hole chain and VH fused to Fc knob chain, termed below hole-VL)

| SEQ ID NO: | Description | Sequence |
|---|---|---|
| 128 | VHCH1 (20H4.9)-Heavy chain hole-VL (DP47) | QVQLQQWGAGLLKPSETLSLTCAVYGGSFSGYYWSWIRQS PEKGLEWIGEINHGGYVTYNPSLESRVTISVDTSKNQFSLKLS SVTAADTAVYYCARDYGPGNYDWYFDLWGRGTLVTVSSA STKGPSVFPLAPSSKSTSGGTAALGCLVKDYFPEPVTVSWNS GALTSGVHTFPAVLQSSGLYSLSSVVTVPSSSLGTQTYICNV NHKPSNTKVDKKVEPKSCDKTHTCPPCPAPEAAGGPSVFLFP PKPKDTLMISRTPEVTCVVVDVSHEDPEVKFNWYVDGVEV HNAKTKPREEQYNSTYRVVSVLTVLHQDWLNGKEYKCKVS NKALGAPIEKTISKAKGQPREPQVCTLPPSRDELTKNQVSLS CAVKGFYPSDIAVEWESNGQPENNYKTTPPVLDSDGSFFLVS KLTVDKSRWQQGNVFSCSVMHEALHNHYTQKSLSLSPGGG GGSGGGGSEIVLTQSPGTLSLSPGERATLSCRASQSVSSSYLA WYQQKPGQAPRLLIYGASSRATGIPDRFSGSGSGTDFTLTISR LEPEDFAVYYCQQYGSSPLTFGQGTKVEIK |
| 129 | VHCH1 (20H4.9)-Heavy chain knob-VH (DP47) | QVQLQQWGAGLLKPSETLSLTCAVYGGSFSGYYWSWIRQS PEKGLEWIGEINHGGYVTYNPSLESRVTISVDTSKNQFSLKLS SVTAADTAVYYCARDYGPGNYDWYFDLWGRGTLVTVSSA STKGPSVFPLAPSSKSTSGGTAALGCLVKDYFPEPVTVSWNS GALTSGVHTFPAVLQSSGLYSLSSVVTVPSSSLGTQTYICNV NHKPSNTKVDKKVEPKSCDKTHTCPPCPAPEAAGGPSVFLFP PKPKDTLMISRTPEVTCVVVDVSHEDPEVKFNWYVDGVEV HNAKTKPREEQYNSTYRVVSVLTVLHQDWLNGKEYKCKVS NKALGAPIEKTISKAKGQPREPQVYTLPPCRDELTKNQVSLW CLVKGFYPSDIAVEWESNGQPENNYKTTPPVLDSDGSFFLYS KLTVDKSRWQQGNVFSCSVMHEALHNHYTQKSLSLSPGGG GGSGGGGSGGGGSGGGGSEVQLLESGGGLVQPGGSLRLSC |

TABLE 17-continued

Sequences of bispecific, bivalent anti-4-1BB/untargeted DP47 human IgG1 P329GLALA antigen binding molecules (Constructs with DP47 VL fused to Fc hole chain and VH fused to Fc knob chain, termed below hole-VL)

| SEQ ID NO: | Description | Sequence |
|---|---|---|
|  |  | AASGFTFSSYAMSWVRQAPGKGLEWVSAISGSGGSTYYADS VKGRFTISRDNSKNTLYLQMNSLRAEDTAVYYCAKGSGFD YWGQGTLVTVSS |
| 46 | VLCL-Light chain (20H4.9) | see Table 1 |

TABLE 18

Sequences of bispecific, bivalent anti-4-1BB/monovalent DP47 human IgG1 P329GLALA antigen binding molecules (Constructs with DP47 VH fused to Fc hole chain and VL fused to Fc knob chain, termed hole-VH)

| SEQ ID NO: | Description | Sequence |
|---|---|---|
| 130 | VHCH1 (20H4.9)-Heavy chain hole-VH (DP47) | QVQLQQWGAGLLKPSETLSLTCAVYGGSFSGYYWSWIRQS PEKGLEWIGEINHGGYVTYNPSLESRVTISVDTSKNQFSLKLS SVTAADTAVYYCARDYGPGNYDWYFDLWGRGTLVTVSSA STKGPSVFPLAPSSKSTSGGTAALGCLVKDYFPEPVTVSWNS GALTSGVHTFPAVLQSSGLYSLSSVVTVPSSSLGTQTYICNV NHKPSNTKVDKKVEPKSCDKTHTCPPCPAPEAAGGPSVFLFP PKPKDTLMISRTPEVTCVVVDVSHEDPEVKFNWYVDGVEV HNAKTKPREEQYNSTYRVVSVLTVLHQDWLNGKEYKCKVS NKALGAPIEKTISKAKGQPREPQVCTLPPSRDELTKNQVSLS CAVKGFYPSDIAVEWESNGQPENNYKTTPPVLDSDGSFFLVS KLTVDKSRWQQGNVFSCSVMHEALHNHYTQKSLSLSPGGG GGSGGGGSEVQLLESGGGLVQPGGSLRLSCAASGFTFSSYA MSWVRQAPGKGLEWVSAISGSGGSTYYADSVKGRFTISRDN SKNTLYLQMNSLRAEDTAVYYCAKGSGFDYWGQGTLVTVSS |
| 131 | VHCH1 (20H4.9)-Heavy chain knob-VL (DP47) | QVQLQQWGAGLLKPSETLSLTCAVYGGSFSGYYWSWIRQS PEKGLEWIGEINHGGYVTYNPSLESRVTISVDTSKNQFSLKLS SVTAADTAVYYCARDYGPGNYDWYFDLWGRGTLVTVSSA STKGPSVFPLAPSSKSTSGGTAALGCLVKDYFPEPVTVSWNS GALTSGVHTFPAVLQSSGLYSLSSVVTVPSSSLGTQTYICNV NHKPSNTKVDKKVEPKSCDKTHTCPPCPAPEAAGGPSVFLFP PKPKDTLMISRTPEVTCVVVDVSHEDPEVKFNWYVDGVEV HNAKTKPREEQYNSTYRVVSVLTVLHQDWLNGKEYKCKVS NKALGAPIEKTISKAKGQPREPQVYTLPPCRDELTKNQVSLW CLVKGFYPSDIAVEWESNGQPENNYKTTPPVLDSDGSFFLYS KLTVDKSRWQQGNVFSCSVMHEALHNHYTQKSLSLSPGGG GGSGGGGSGGGGSGGGGSEIVLTQSPGTLSLSPGERATLSCR ASQSVSSSYLAWYQQKPGQAPRLLIYGASSRATGIPDRFSGS GSGTDFTLTISRLEPEDFAVYYCQQYGSSPLTFGQGTKVEIK |
| 46 | VLCL-Light chain (20H4.9) | see Table 1 |

The bispecific 2+1 anti-4-1BB DP47 huIgG1 P329GLALA antigen binding molecules were produced by co-transfecting HEK293-EBNA cells with the mammalian expression vectors using polyethylenimine. The cells were transfected with the corresponding expression vectors in a 1:1:1 ratio ("vector knob heavy chain": "vector light chain": "vector hole heavy chain"). The production was carried out as described in Example 1.

Example 5

Preparation, Purification and Characterization of Bispecific Antigen Binding Molecules with Bivalent Binding to Mouse 4-1BB and Monovalent Binding to FAP 5.1 Generation of Bispecific Antibodies with a Bivalent Binding to Mouse 4-1BB and a Monovalent Binding to FAP Bispecific agonistic mouse 4-1BB antibodies with bivalent binding for 4-1BB and monovalent binding for FAP, also termed 2+1, have been prepared in analogy to FIGS. 1A and 1B. In this example, the first heavy chain HC1 of the construct was comprised of the following components: VHCH1 of an anti-4-1BB (clone MU137-1) followed by Fc containing the mutations Lys392Asp and Lys409Asp (termed Fc-DD), at which C-terminus a VL, or VH, of anti-FAP binder (clone 28H1) was fused. The second heavy chain HC2 was comprised of VHCH1 of anti-4-1BB (clone MU137-1) followed by Fc containing the mutation Glu356Lys and Asp399Lys (termed Fc-KK), at which C-terminus a VH, or VL, of anti-FAP binder (clone 28H1) was fused. The DDKK mutations for enhancing antibody Fc heterodimer formation are inter alia described by Gunasekaran et al., J. Biol. Chem. 2010, 19637-19646. Combination of the targeted anti-FAP-Fc DD with the anti-4-1BB-Fc KK chain allows generation of a heterodimer, which includes a FAP binding moiety and two murine mouse 4-1BB binding Fabs (FIGS. 1A and 1B).

DAPG mutations were introduced in the constant regions of the heavy chains to abrogate binding to mouse Fc gamma receptors according to the method described e.g. in Baudino et al. J. Immunol. (2008), 181, 6664-6669, or in WO 2016/030350 A1. Briefly, the Asp265Ala and Pro329Gly mutations have been introduced in the constant region of the Fc-DD and Fc-KK heavy chains to abrogate binding to Fc gamma receptors (numbering according to Kabat EU index; i.e. D265A, P329G).

The amino acid sequences for 2+1 anti-4-1BB(MU137-1), anti-FAP(28H1) construct with a-FAP(28H1) VH fused to Fc-KK and VL fused to Fc-DD chain can be found respectively in Table 19. The amino acid sequences for 2+1 anti-4-1BB(MU137-1), anti-FAP(28H1) construct with a-FAP(28H1) VL fused to Fc-KK and VH fused to Fc-DD chain can be found respectively in Table 20.

TABLE 19

Sequences of bispecific, bivalent anti-4-1BB (MU137-1)/anti-FAP (28H1) mouse IgG1 DAPG antigen binding molecules (Constructs with FAP VL fused to Fc-DD chain and VH fused to Fc-KK chain, also termed below Fc-DD-VL)

| SEQ ID NO: | Description | Sequence |
|---|---|---|
| 132 | VHCH1 (MU137-1)-Heavy chain Fc-DD-VL (28H1) | DVQLVESGGGLVQPGRSLKLSCAASGFIFSYFDMAWVRQAP TKGLEWVASISPSGDIPYYRDSVKGRFTVSRENAKSSLYLQM DSLRSEDTATYYCARRSYGGYSELDYWGQGVMVTVSSAKT TPPSVYPLAPGSAAQTNSMVTLGCLVKGYFPEPVTVTWNSG SLSSGVHTFPAVLQSDLYTLSSSVTVPSSTWPSQTVTCNVAH PASSTKVDKKIVPRDCGCKPCICTVPEVSSVFIFPPKPKDVLTI TLTPKVTCVVVAISKDDPEVQFSWFVDDVEVHTAQTKPREE QINSTFRSVSELPIMHQDWLNGKEFKCRVNSAAFGAPIEKTIS KTKGRPKAPQVYTIPPPKEQMAKDKVSLTCMITNFFPEDITV EWQWNGQPAENYDNTQPIMDTDGSYFVYSDLNVQKSNWE AGNTFTCSVLHEGLHNHHTEKSLSHSPGGGGSGGGSGGG GSGGGGSEIVLTQSPGTLSLSPGERATLSCRASQSVSRSYLA WYQQKPGQAPRLLIIGASTRATGIPDRFSGSGSGTDFTLTISR LEPEDFAVYYCQQGQVIPPTFGQGTKVEIK |
| 133 | VHCH1 (20H4.9)-Heavy chain Fc-KK-VH (28H1) | DVQLVESGGGLVQPGRSLKLSCAASGFIFSYFDMAWVRQAP TKGLEWVASISPSGDIPYYRDSVKGRFTVSRENAKSSLYLQM DSLRSEDTATYYCARRSYGGYSELDYWGQGVMVTVSSAKT TPPSVYPLAPGSAAQTNSMVTLGCLVKGYFPEPVTVTWNSG SLSSGVHTFPAVLQSDLYTLSSSVTVPSSTWPSQTVTCNVAH PASSTKVDKKIVPRDCGCKPCICTVPEVSSVFIFPPKPKDVLTI TLTPKVTCVVVAISKDDPEVQFSWFVDDVEVHTAQTKPREE QINSTFRSVSELPIMHQDWLNGKEFKCRVNSAAFGAPIEKTIS KTKGRPKAPQVYTIPPPKKQMAKDKVSLTCMITNFFPEDITV EWQWNGQPAENYKNTQPIMKTDGSYFVYSKLNVQKSNWE AGNTFTCSVLHEGLHNHHTEKSLSHSPGGGGSGGGGSGGG GSGGGGSEVQLLESGGGLVQPGGSLRLSCAASGFTFSSHAM SWVRQAPGKGLEWVSAIWASGEQYYADSVKGRFTISRDNS KNTLYLQMNSLRAEDTAVYYCAKGWLGNFDYWGQGTLVTVSS |
| 134 | VLCL-Light chain (MU137-1) | DIQMTQSPASLSASLEEIVTITCQASQDIGNWLAWYHQKPGK SPQLLIYGTSSLADGVPSRFSGSSSGSQYSLKISRLQVEDIGIY YCLQAYGAPWTFGGGTKLELKRADAAPTVSIFPPSSEQLTSG GASVVCFLNNFYPKDINVKWKIDGSERQNGVLNSWTDQDS KDSTYSMSSTLTLTKDEYERHNSYTCEATHKTSTSPIVKSFN RNEC |

TABLE 20

Sequences of bispecific, bivalent anti-4-1BB (MU137-1)/monovalent anti-FAP (28H1) mouse IgG1 DAPG antigen binding molecules (Constructs with FAP VH fused to Fc DD chain and VL fused to Fc KK chain, termed Fc-DD-VH)

| SEQ ID NO: | Description | Sequence |
|---|---|---|
| 135 | VHCH1 (MU137-1)-Heavy chain Fc-DD-VH (28H1) | DVQLVESGGGLVQPGRSLKLSCAASGFIFSYFDMAW VRQAPTKGLEWVASISPSGDIPYYRDSVKGRFTVSR ENAKSSLYLQMDSLRSEDTATYYCARRSYGGYSELD YWGQGVMVTVSSAKTTPPSVYPLAPGSAAQTNSMVT LGCLVKGYFPEPVTVTWNSGSLSSGVHTFPAVLQSD LYTLSSSVTVPSSTWPSQTVTCNVAHPASSTKVDKK IVPRDCGCKPCICTVPEVSSVFIFPPKPKDVLTITL TPKVTCVVVAISKDDPEVQFSWFVDDVEVHTAQTKP REEQINSTFRSVSELPIMHQDWLNGKEFKCRVNSAA FGAPIEKTISKTKGRPKAPQVYTIPPPKEQMAKDKV SLTCMITNFFPEDITVEWQWNGQPAENYDNTQPIMD TDGSYFVYSDLNVQKSNWEAGNTFTCSVLHEGLHNH |

TABLE 20-continued

Sequences of bispecific, bivalent anti-4-1BB (MU137-1)/monovalent anti-FAP (28H1) mouse IgG1 DAPG antigen binding molecules (Constructs with FAP VH fused to Fc DD chain and VL fused to Fc KK chain, termed Fc-DD-VH)

| SEQ ID NO: | Description | Sequence |
|---|---|---|
| | | HTEKSLSHSPGGGGSGGGGSGGGGSGGGGSEVQLL ESGGGLVQPGGSLRLSCAASGFTFSSHAMSWVRQAP GKGLEWVSAIWASGEQYYADSVKGRFTISRDNSKNT LYLQMNSLRAEDTAVYYCAKGWLGNFDYWGQGTLVT VSS |
| 136 | VHCH1 (MU137-1)-Heavy chain Fc-KK-VL (28H1) | DVQLVESGGGLVQPGRSLKLSCAASGFIFSYFDMAW VRQAPTKGLEWVASISPSGDIPYYRDSVKGRFTVSR ENAKSSLYLQMDSLRSEDTATYYCARRSYGGYSELD YWGQGVMVTVSSAKTTPPSVYPLAPGSAAQTNSMVT LGCLVKGYFPEPVTVTWNSGSLSSGVHTFPAVLQSD LYTLSSSVTVPSSTWPSQTVTCNVAHPASSTKVDKK IVPRDCGCKPCICTVPEVSSVFIFPPKPKDVLTIT LTPKVTCVVVAISKDDPEVQFSWFVDDVEVHTAQT KPREEQINSTFRSVSELPIMHQDWLNGKEFKCRVN SAAFGAPIEKTISKTKGRPKAPQVYTIPPPKKQMA KDKVSLTCMITNFFPEDITVEWQWNGQPAENYKNT QPIMKTDGSYFVYSKLNVQKSNWEAGNTFTCSVLH EGLHNHHTEKSLSHSPGGGGSGGGGSGGGGSGGG GSEIVLTQSPGTLSLSPGERATLSCRASQSVSRSY LAWYQQKPGQAPRLLIIGASTRATGIPDRFSGSGS GTDFTLTISRLEPEDFAVYYCQQGQVIPPTFGQGT KVEIK |
| 134 | VLCL-Light chain (MU137-1) | see Table 19 |

The bispecific 2+1 anti-4-1BB anti-FAP muIgG1 DAPG was produced by co-transfecting CHO-K1 cells growing in suspension with the mammalian expression vectors using eviFect (Evitria AG). The cells were transfected with the corresponding expression vectors in a 1:1:1 ratio ("vector Fc-DD heavy chain": "vector light chain":"vector Fc-KK heavy chain").

For transfection CHO-K1 cells are cultivated in suspension serum free in eviMake (Evitria AG) culture medium. After 7 days at 37° C. in an incubator with a 5% $CO_2$ atmosphere, cultivation supernatant is collected for purification by centrifugation and the solution is sterile filtered (0.22 mm filter) and kept at 4° C.

Secreted proteins were purified from cell culture supernatants by affinity chromatography using Protein A, followed by size exclusion chromatography. For affinity chromatography, the supernatant was loaded on a Protein A MabSelectSure column (CV=5 mL, GE Healthcare) equilibrated with 40 mL 20 mM sodium phosphate, 20 mM sodium citrate pH 7.5. Unbound protein was removed by washing with at least 10 column volumes of 20 mM sodium phosphate, 20 mM sodium citrate containing buffer (pH 7.5). The bound protein was eluted using a linear pH-gradient of sodium chloride (from 20 to 100 mM) created over 15 column volumes of 20 mM sodium citrate, 100 mM NaCl, 100 mM Glycine, pH 3.0. The column was then washed with 10 column volumes of 20 mM sodium citrate, 100 mM NaCl, 100 mM Glycine, pH 3.0. The pH of collected fractions was adjusted by adding ¹/₄₀ (v/v) of 2M Tris, pH8.0. The protein was concentrated and filtered prior to loading on a HiLoad Superdex 16/600 S200 column (GE Healthcare) equilibrated with 20 mM Histidine, 140 mM NaCl, pH6.0.

The protein concentration of purified bispecific constructs was determined by measuring the OD at 280 nm, using the molar extinction coefficient calculated on the basis of the amino acid sequence. Purity and molecular weight of the bispecific constructs were analyzed by CE-SDS in the presence and absence of a reducing agent (Invitrogen, USA) using a LabChipGXII (Caliper). The aggregate content of bispecific constructs was analyzed using a TSKgel G3000 SW XL analytical size-exclusion column (Tosoh) equilibrated in a 25 mM $K_2HPO_4$, 125 mM NaCl, 200 mM L-Arginine Monohydrocloride, 0.02% (w/v) $NaN_3$, pH 6.7 running buffer at 25° C.

TABLE 21

Biochemical analysis of bispecific antigen binding molecules with a bivalent binding to 4-1BB and a monovalent binding to FAP (2 + 1) anti-4-1BB (MU137-1), anti-FAP(28H1) mouse IgG1 DAPG

| Molecule | Monomer [%] | Yield [mg/l] | CE-SDS (non-red) |
|---|---|---|---|
| 4-1BB (MU137-1)/FAP(28H1) DAPG IgG1 2 + 1 (Fc-DD-VL) | 98 | 3.6 | 92 |

5.2 Functional In Vitro Characterization Using Mouse Splenocyte Activation Assay For the functional assay mouse splenocytes are co-cultured with mouse fibroblast cell line NIH/3T3-mouseFAP clone 36. The mouse fibroblast cell line NIH/3T3-mouseFAP clone 36 was received by transfecting parental NIH/3T3 cell line (ATCC—American Type Culture Collection, CRL-1658) with a expression plasmid encoding mouse FAP under a CMV promoter. Cells NIH/3T3-mouseFAP clone 36 are maintained in the presence of 1.5 µg/mL puromycin (InvivoGen, Cat.-No.: ant-pr-5) in DMEM (GIBCO by Life Technologies, Cat No 42430-082) supplied with 10% FBS (Gibco by Life Technologies, γ-irradiated, heat-inactivated) and 1% (v/v) GlutaMAX-I (GIBCO by Life Technologies, Cat.-No. 35050-038). For the functional assay mouse spleens were isolated from 6-8 week old female C57BL/6 mice into sterile DPBS (Gibco by Life Technologies, Cat.-No. 14190136). A single cell splenocyte cell suspension were produced by separating spleens through a 70 µm Falcon® cell strainer (Corning, Cat.-No. 352350) and filtering through a 30 µm Pre-separation filter (Miltenyi Biotec, Cat.-No. 130-041-407) in RPMI 1640 medium (Gibco by Life Technologies, Cat.-No. 42401-042) supplied with 10% fetal bovine serum (FBS, Gibco by Life Technologies, γ-irradiated, heat-inactivated), 1% (v/v) GlutaMAX-I (GIBCO by Life Technologies, Cat.-No. 35050-038), 1 mM Sodium-Pyruvat (SIGMA-Aldrich, Cat.-No. 58636) and 50 µM beta-Mercaptoethanol. Erythrocytes were lysed by resuspending cells in ACK Lysis buffer (0.15M NH4CL, 10 mM KHCO3, 0.1 mM EDTA in bi-distilled water (ddH2O, pH 7.2) and incubated for 10 min at RT. Lysis was stopped with FBS, cells were washed with sterile DPBS and labeled with 0.5 µM CellTrace Violet Cell Proliferation dye-labeled (Cell tracer, Cat.-No. C34557) in 37° C. PBS for 10 min. The labeling was stopped with FBS. 0.15×106 violet cell proliferation dye-labeled splenocytes were co-cultured with 0.02×106 adherent 50 Gy irradiated NIH/3T3-mouseFAP clone 36 cells, 0.5 mg/mL (~3.57 nM) agonistic anti-mouse CD3 armenian hamster IgG (clone 145-2C11, BD, Cat.-No. 553057) and different titrated concentrations of agonistic mouse 4-1BB antibody antibodies (clone MU137-1) or control (LEAF purified mouse IgG1 k Isotype control clone MOPC-21, BioLegend, Cat.-No. 400153) in 200 µL/well RPMI 1640 medium (Gibco by Life Technologies, Cat.-No. 42401-042) supplied with 10% fetal bovine serum (FBS, Gibco by Life Technologies, γ-irradiated, heat-inactivated), 1% (v/v) GlutaMAX-I (GIBCO by Life Technologies, Cat.-No. 35050-038), 1 mM Sodium-Pyruvat (SIGMA-Aldrich, Cat.-No. S8636) and 50 04 beta-Mercaptoethanol in 96-well tissue culture round-bottom plates (TTP, Cat.-No. 92097) for four days.

After four days, cells were washed with FACS buffer and stained for 30 min at 4° C. in 50 μL/well cold DPBS containing 1:5000 diluted LIVE/DEAD Fixable Aqua Dead Cell Stain. After washing the cells with PBS cells were stained in 50 μL/well cold FACS buffer containing anti-mouse CD8a ratIgG2a-APC/Cy7 (BioLegend, Cat.-No. 100714, clone 53-6.7), anti-mouse CD4 Rat IgG2b, κ-APC (BioLegend, Cat.-No. 100412, clone GK1.5) anti-mouse CD137 (4-1BB) Syrian hamster IgG-PE (BioLegend, Cat.-No. 106106, clone 17B5) and anti-mouse CD25-PErCP-Cy5.5 ratIgG2b (BioLegend, Cat.-No. 1019112) for 30 min at 4° C. Cells were washed and incubated for 30 min at 4° C. in freshly prepared Fix/Perm Buffer (Foxp3/Transcription Factor Staining Buffer Set, eBioscience, Cat.-No. 00-5523-00). After washing cells were stained with 50 μL/well Perm-Buffer containing anti-mouse granzyme B-ratIgG2b-PE (eBioscience, Cat.-No. 128822, clone 16G6) for 1 h at 4° C. Cells were then washed, resuspended in FACS buffer and acquired using 3-laser MACSQuant Analyzer 10 (Miltenyi Biotech) and analyzed using Flow Jo v10.0.7 (FlowJo LLC).

As shown in FIGS. 14A to 14J, the activation of mouse T cells with 0.5 ug/mL agonistic anti-mouse CD3 armenian hamster IgG (signal 1) in combination with crosslinked agonistic anti-mouse 4-1BB antibody leads to increased proliferation leads to increased 4-1BB expression in CD8+ T cells (FIG. 14A) and CD4+ T cells (FIG. 14B), increased CD25-expression in CD8+ T cells (FIG. 14C) and CD4+ T cells (FIG. 14D), Granzyme B expression in CD8+ T cells (FIG. 14E) and CD4+ T cells (FIG. 14F), proliferation in CD8+ T cells (FIG. 14G) and CD4+ T cells (FIG. 14H) and an increase size shown by increase sidewards scatter values in CD8+ T cells (FIG. 14I) and CD4+ T cells (FIG. 14J). For 4-1BB synergy the agonistic anti-mouse clone MU137-1 has to be crosslinked. Either this is mediated by FcγR-crosslinking (filled black diamond, mouse 4-1BB (MU137-1) moIgG1) as shown in FIG. 14H by slightly increased CD4 proliferation, or in a much stronger synergistic manner via bispecific FAP-binding (grey stars, dotted line, mouse 4-1BB (MU137-1)×FAP (28H1) moIgG1 DAPG 2+1) as shown in FIGS. 14A to 14F and FIGS. 14H to 14J. The mouse 4-1BB (MU137-1) moIgG1 DAP antibody (open black diamond, dotted line), inert of FcγR-binding and therefore crosslinking has now synergistic effect above background.

Example 6

Preparation, Purification and Characterization of Bispecific Antigen Binding Molecules with Bivalent Binding to 4-1BB and Monovalent Binding to CEA 6.1 Generation of Bispecific Antibodies with a Bivalent Binding to 4-1BB and a Monovalent Binding to CEA Bispecific agonistic 4-1BB antibodies with bivalent binding for 4-1BB and monovalent binding for CEA, also termed 2+1, were prepared as depicted in FIGS. 1A and 1B. The knobs into hole technology was applied by introducing the S354C/T366W mutations in the first heavy chain HC1 (Fc knob heavy chain) and introducing the Y349C/T366S/L368A/Y407V mutations in the second heavy chain HC2 (Fc hole heavy chain) to allow generation of a heterodimer.

In this example, the first heavy chain HC1 of the construct was comprised of the following components: VHCH1 of anti-4-1BB binder (clone 20H4.9), followed by Fc knob, at which C-terminus a VL or VH of anti-CEA binder (clone T84.66-LCHA or A5B7) was fused. The second heavy chain HC2 was comprised of VHCH1 of anti-4-1BB followed by Fc hole, at which C-terminus a VH or VL, respectively, of anti-CEA binder (clone T84.66-LCHA or A5B7) was fused. The generation and preparation of CEA binder T84.66-LCHA is described in WO 2016/075278 A2, which is incorporated herein by reference. The VH and VL sequences of CEA clone A5B7 were obtained from WO 2007/071426 and are derived from murine anti-CEA clone A5B7. For the 4-1BB binder, the VH and VL sequences of clone 20H4.9 were obtained in accordance with U.S. Pat. No. 7,288,638 B2 or U.S. Pat. No. 7,659,384 B2. Combination of the two heavy chains allows generation of a heterodimer, which includes a CEA binding moiety and two 4-1BB binding Fabs (FIGS. 1A and 1B).

The Pro329Gly, Leu234Ala and Leu235Ala mutations have been introduced in the constant region of the knob and hole heavy chains to abrogate binding to Fc gamma receptors according to the method described in International Patent Appl. Publ. No. WO2012/130831A1.

The bispecific 2+1 anti-4-1BB anti-CEA huIgG1 P329GLALA antibodies were produced by co-transfecting HEK293-EBNA cells with the mammalian expression vectors using polyethylenimine. The cells were transfected with the corresponding expression vectors in a 1:1:1 ratio ("vector knob heavy chain": "vector light chain":"vector hole heavy chain").

The base pair and amino acid sequences for 2+1 anti-4-1BB, anti-CEA constructs with a-CEA (T84.66-LCHA) VH fused to the Fc knob heavy chain and VL fused to Fc hole heavy chain can be found respectively in Table 22.

TABLE 22

Sequences of bispecific, bivalent anti-4-1BB/monovalent anti-CEA (T84.66-LCHA) human IgG1 P329GLALA antigen binding molecules (Constructs with a-CEA VL fused to Fc hole chain and VH fused to Fc knob chain, termed hole-VL)

| SEQ ID NO: | Description | Sequence |
|---|---|---|
| 63 | VHCH1 (20H4.9)-Heavy chain hole-VL (T84.66-LCHA) (nucleotide sequence) | CAGGTGCAGCTGCAGCAGTGGGGAGCCGGCCTGCTGAAG CCCAGCGAGACACTGAGCCTGACCTGCGCCGTGTACGGC GGCAGCTTCAGCGGCTACTACTGGTCCTGGATCCGGCAGA GCCCCGAGAAGGGCCTGGAATGGATCGGCGAGATCAACC ACGGCGGCTACGTGACCTACAACCCCAGCCTGGAAAGCA GAGTGACCATCAGCGTGGACACCAGCAAGAACCAGTTCA |

TABLE 22-continued

Sequences of bispecific, bivalent anti-4-1BB/monovalent anti-CEA
(T84.66-LCHA) human IgG1 P329GLALA antigen binding molecules
(Constructs with a-CEA VL fused to Fc hole chain and VH fused
to Fc knob chain, termed hole-VL)

| SEQ ID NO: | Description | Sequence |
|---|---|---|
| | | GCCTGAAGCTGAGCAGCGTGACAGCCGCCGACACCGCCG<br>TGTACTACTGCGCCAGAGACTACGGCCCTGGCAACTACG<br>ACTGGTACTTCGACCTGTGGGGCAGAGGCACCCTGGTGA<br>CAGTGTCCAGCGCTAGCACCAAGGGCCCATCGGTCTTCC<br>CCTGGCACCCTCCTCCAAGAGCACCTCTGGGGGCACAGC<br>GGCCCTGGGCTGCCTGGTCAAGGACTACTTCCCCGAACCG<br>GTGACGGTGTCGTGGAACTCAGGCGCCCTGACCAGCGGC<br>GTGCACACCTTCCCGGCTGTCCTACAGTCCTCAGGACTCT<br>ACTCCCTCAGCAGCGTGGTGACCGTGCCCTCCAGCAGCTT<br>GGGCACCCAGACCTACATCTGCAACGTGAATCACAAGCC<br>CAGCAACACCAAGGTGGACAAGAAAGTTGAGCCCAAATC<br>TTGTGACAAAACTCACACATGCCCACCGTGCCCAGCACCT<br>GAAGCTGCAGGGGGACCGTCAGTCTTCCTCTTCCCCCCAA<br>AACCCAAGGACACCCTCATGATCTCCCGGACCCCTGAGGT<br>CACATGCGTGGTGGTGGACGTGAGCCACGAAGACCCTGA<br>GGTCAAGTTCAACTGGTACGTGGACGGCGTGGAGGTGCA<br>TAATGCCAAGACAAAGCCGCGGGAGGAGCAGTACAACAG<br>CACGTACCGTGTGGTCAGCGTCCTCACCGTCCTGCACCAG<br>GACTGGCTGAATGGCAAGGAGTACAAGTGCAAGGTCTCC<br>AACAAAGCCCTCGGCGCCCCCATCGAGAAAACCATCTCC<br>AAAGCCAAAGGGCAGCCCCGAGAACCACAGGTGTGCACC<br>CTGCCCCCATCCCGGGATGAGCTGACCAAGAACCAGGTC<br>AGCCTCTCGTGCGCAGTCAAAGGCTTCTATCCCAGCGACA<br>TCGCCGTGGAGTGGGAGAGCAATGGGCAGCCGGAGAACA<br>ACTACAAGACCACGCCTCCCGTGCTGGACTCCGACGGCTC<br>CTTCTTCCTCGTGAGCAAGCTCACCGTGGACAAGAGCAGG<br>TGGCAGCAGGGGAACGTCTTCTCATGCTCCGTGATGCATG<br>AGGCTCTGCACAACCACTACACGCAGAAGAGCCTCTCCCT<br>GTCTCCGGGTGGAGGCGGCGGAAGCGGAGGAGGAGGATC<br>CGGCGGCGGAGGTTCCGGAGGCGGAGGATCCGAGATCGT<br>GCTGACCCAGAGCCCTGCCACCCTGTCACTGTCTCCAGGC<br>GAGAGAGCCACCCTGAGCTGTAGAGCCGGCGAGAGCGTG<br>GACATCTTCGGCGTGGGATTTCTGCACTGGTATCAGCAGA<br>AGCCCGGCCAGGCCCCCAGACTGCTGATCTACAGAGCCA<br>GCAACCGGGCCACAGGCATCCCCGCCAGATTTTCTGGCTC<br>TGGCAGCGGCACCGACTTCACCCTGACAATCAGCAGCCT<br>GGAACCCGAGGACTTCGCCGTGTACTACTGCCAGCAGAC<br>CAACGAGGACCCCTACACCTTTGGCCAGGGCACCAAGCT<br>GGAAATCAAG |
| 64 | VHCH1<br>(20H4.9)-Heavy<br>chain knob-VH<br>(T84.66-LCHA)<br>(nucleotide<br>sequence) | CAGGTGCAGCTGCAGCAGTGGGGAGCCGGCCTGCTGAAG<br>CCCAGCGAGACACTGAGCCTGACCTGCGCCGTGTACGGC<br>GGCAGCTTCAGCGGCTACTACTGGTCCTGGATCCGGCAGA<br>GCCCCGAGAAGGGCCTGGAATGGATCGGCGAGATCAACC<br>ACGGCGGCTACGTGACCTACAACCCCAGCCTGGAAAGCA<br>GAGTGACCATCAGCGTGGACACCAGCAAGAACCAGTTCA<br>GCCTGAAGCTGAGCAGCGTGACAGCCGCCGACACCGCCG<br>TGTACTACTGCGCCAGAGACTACGGCCCTGGCAACTACG<br>ACTGGTACTTCGACCTGTGGGGCAGAGGCACCCTGGTGA<br>CAGTGTCCAGCGCTAGCACCAAGGGCCCATCGGTCTTCC<br>CCTGGCACCCTCCTCCAAGAGCACCTCTGGGGGCACAGC<br>GGCCCTGGGCTGCCTGGTCAAGGACTACTTCCCCGAACCG<br>GTGACGGTGTCGTGGAACTCAGGCGCCCTGACCAGCGGC<br>GTGCACACCTTCCCGGCTGTCCTACAGTCCTCAGGACTCT<br>ACTCCCTCAGCAGCGTGGTGACCGTGCCCTCCAGCAGCTT<br>GGGCACCCAGACCTACATCTGCAACGTGAATCACAAGCC<br>CAGCAACACCAAGGTGGACAAGAAAGTTGAGCCCAAATC<br>TTGTGACAAAACTCACACATGCCCACCGTGCCCAGCACCT<br>GAAGCTGCAGGGGGACCGTCAGTCTTCCTCTTCCCCCCAA<br>AACCCAAGGACACCCTCATGATCTCCCGGACCCCTGAGGT<br>CACATGCGTGGTGGTGGACGTGAGCCACGAAGACCCTGA<br>GGTCAAGTTCAACTGGTACGTGGACGGCGTGGAGGTGCA<br>TAATGCCAAGACAAAGCCGCGGGAGGAGCAGTACAACAG<br>CACGTACCGTGTGGTCAGCGTCCTCACCGTCCTGCACCAG<br>GACTGGCTGAATGGCAAGGAGTACAAGTGCAAGGTCTCC<br>AACAAAGCCCTCGGCGCCCCCATCGAGAAAACCATCTCC<br>AAAGCCAAAGGGCAGCCCCGAGAACCACAGGTGTACACC<br>CTGCCCCCTGCAGAGATGAGCTGACCAAGAACCAGGTG<br>TCCCTGTGGTGTCTGGTCAAGGGCTTCTACCCCAGCGATA<br>TCGCCGTGGAGTGGGAGAGCAACGGCCAGCCTGAGAACA<br>ACTACAAGACCACCCCCCCTGTGCTGGACAGCGACGGCA<br>GCTTCTTCCTGTACTCCAAACTGACCGTGGACAAGAGCCG |

TABLE 22-continued

Sequences of bispecific, bivalent anti-4-1BB/monovalent anti-CEA (T84.66-LCHA) human IgG1 P329GLALA antigen binding molecules (Constructs with a-CEA VL fused to Fc hole chain and VH fused to Fc knob chain, termed hole-VL)

| SEQ ID NO: | Description | Sequence |
|---|---|---|
|  |  | GTGGCAGCAGGGCAACGTGTTCAGCTGCAGCGTGATGCA CGAGGCCCTGCACAACCACTACACCCAGAAGTCCCTGAG CCTGAGCCCCGGCGGAGGCGGCGGAAGCGGAGGAGGAG GATCTGGGGGCGGAGGTTCCGGAGGCGGTGGATCTCAGG TGCAGCTGGTGCAGTCTGGCGCCGAAGTGAAGAAACCCG GCAGCAGCGTGAAGGTGTCCTGCAAGGCCAGCGGCTTCA ACATCAAGGACACCTACATGCACTGGGTGCGCCAGGCCC CTGGACAGGGACTGGAATGGATGGGCAGAATCGACCCCG CCAACGGCAACAGCAAATACGTGCCCAAGTTCCAGGGCA GAGTGACCATCACCGCCGACACCAGCACCTCCACCGCCT ACATGGAACTGAGCAGCCTGCGGAGCGAGGACACCGCCG TGTACTACTGTGCCCCCTTCGGCTACTACGTGTCCGACTA CGCCATGGCCTATTGGGGCCAGGGCACACTCGTGACCGT GTCCTCT |
| 43 | VLCL-Light chain (20H4.9) (nucleotide sequence) | see Table 1 |
| 65 | VHCH1 (20H4.9)-Heavy chain hole-VL (T84.66-LCHA) | QVQLQQWGAGLLKPSETLSLTCAVYGGSFSGYYWSWIRQS PEKGLEWIGEINHGGYVTYNPSLESRVTISVDTSKNQFSLKLS SVTAADTAVYYCARDYGPGNYDWYFDLWGRGTLVTVSSA STKGPSVFPLAPSSKSTSGGTAALGCLVKDYFPEPVTVSWNS GALTSGVHTFPAVLQSSGLYSLSSVVTVPSSSLGTQTYICNV NHKPSNTKVDKKVEPKSCDKTHTCPPCPAPEAAGGPSVFLFP PKPKDTLMISRTPEVTCVVVDVSHEDPEVKFNWYVDGVEV HNAKTKPREEQYNSTYRVVSVLTVLHQDWLNGKEYKCKVS NKALGAPIEKTISKAKGQPREPQVCTLPPSRDELTKNQVSLS CAVKGFYPSDIAVEWESNGQPENNYKTTPPVLDSDGSFFLVS KLTVDKSRWQQGNVFSCSVMHEALHNHYTQKSLSLSPGGG GGSGGGGSGGGGSGGGGSEIVLTQSPATLSLSPGERATLSCR AGESVDIFGVGFLHWYQQKPGQAPRLLIYRASNRATGIPARF SGSGSGTDFTLTISSLEPEDFAVYYCQQTNEDPYTFGQGTKL EIK |
| 66 | VHCH1 (20H4.9)-Heavy chain knob-VH (T84.66-LCHA) | QVQLQQWGAGLLKPSETLSLTCAVYGGSFSGYYWSWIRQS PEKGLEWIGEINHGGYVTYNPSLESRVTISVDTSKNQFSLKLS SVTAADTAVYYCARDYGPGNYDWYFDLWGRGTLVTVSSA STKGPSVFPLAPSSKSTSGGTAALGCLVKDYFPEPVTVSWNS GALTSGVHTFPAVLQSSGLYSLSSVVTVPSSSLGTQTYICNV NHKPSNTKVDKKVEPKSCDKTHTCPPCPAPEAAGGPSVFLFP PKPKDTLMISRTPEVTCVVVDVSHEDPEVKFNWYVDGVEV HNAKTKPREEQYNSTYRVVSVLTVLHQDWLNGKEYKCKVS NKALGAPIEKTISKAKGQPREPQVYTLPPCRDELTKNQVSLW CLVKGFYPSDIAVEWESNGQPENNYKTTPPVLDSDGSFFLYS KLTVDKSRWQQGNVFSCSVMHEALHNHYTQKSLSLSPGGG GGSGGGGSGGGGSGGGGSQVQLVQSGAEVKKPGSSVKVSC KASGFNIKDTYMHWVRQAPGQGLEWMGRIDPANGNSKYV PKFQGRVTITADTSTSTAYMELSSLRSEDTAVYYCAPFGYYV SDYAMAYWGQGTLVTVSS |
| 46 | VLCL-Light chain (20H4.9) | see Table 1 |

The base pair and amino acid sequences for 2+1 anti-4-1BB, anti-CEA (T84.66-LCHA) constructs with a-CEA (T84.66-LCHA) VL fused to the Fc knob heavy chain and VH fused to Fc hole heavy chain can be found respectively in Table 23.

TABLE 23

Sequences of bispecific, bivalent anti-4-1BB/monovalent anti-CEA (T84.66-LCHA) human IgG1 P329GLALA antigen binding molecules (Constructs with a-CEA VH fused to Fc hole chain and VL fused to Fc knob chain, termed hole-VH)

| SEQ ID NO: | Description | Sequence |
|---|---|---|
| 67 | VHCH1 (20H4.9)-Heavy chain hole-VH (T84.66-LCHA) (nucleotide sequence) | CAGGTGCAGCTGCAGCAGTGGGGAGCCGGCCTGCTGAAG<br>CCCAGCGAGACACTGAGCCTGACCTGCGCCGTGTACGGC<br>GGCAGCTTCAGCGGCTACTACTGGTCCTGGATCCGGCAGA<br>GCCCCGAGAAGGGCCTGGAATGGATCGGCGAGATCAACC<br>ACGGCGGCTACGTGACCTACAACCCCAGCCTGGAAAGCA<br>GAGTGACCATCAGCGTGGACACCAGCAAGAACCAGTTCA<br>GCCTGAAGCTGAGCAGCGTGACAGCCGCCGACACCGCCG<br>TGTACTACTGCGCCAGAGACTACGGCCCTGGCAACTACG<br>ACTGGTACTTCGACCTGTGGGGCAGAGGCACCCTGGTGA<br>CAGTGTCCAGCGCTAGCACCAAGGGCCCATCGGTCTTCCC<br>CCTGGCACCCTCCTCCAAGAGCACCTCTGGGGGCACAGC<br>GGCCCTGGGCTGCCTGGTCAAGGACTACTTCCCCGAACCG<br>GTGACGGTGTCGTGGAACTCAGGCGCCCTGACCAGCGGC<br>GTGCACACCTTCCCGGCTGTCCTACAGTCCTCAGGACTCT<br>ACTCCCTCAGCAGCGTGGTGACCGTGCCCTCCAGCAGCTT<br>GGGCACCCAGACCTACATCTGCAACGTGAATCACAAGCC<br>CAGCAACACCAAGGTGGACAAGAAAGTTGAGCCCAAATC<br>TTGTGACAAAACTCACACATGCCCACCGTGCCCAGCACCT<br>GAAGCTGCAGGGGACCGTCAGTCTTCCTCTTCCCCCCAA<br>AACCCAAGGACACCCTCATGATCTCCCGGACCCCTGAGGT<br>CACATGCGTGGTGGTGGACGTGAGCCACGAAGACCCTGA<br>GGTCAAGTTCAACTGGTACGTGGACGGCGTGGAGGTGCA<br>TAATGCCAAGACAAAGCCGCGGGAGGAGCAGTACAACAG<br>CACGTACCGTGTGGTCAGCGTCCTCACCGTCCTGCACCAG<br>GACTGGCTGAATGGCAAGGAGTACAAGTGCAAGGTCTCC<br>AACAAAGCCCTCGGCGCCCCCATCGAGAAAACCATCTCC<br>AAAGCCAAAGGGCAGCCCCGAGAACCACAGGTGTGCACC<br>CTGCCCCCATCCCGGGATGAGCTGACCAAGAACCAGGTC<br>AGCCTCTCGTGCGCAGTCAAAGGCTTCTATCCCAGCGACA<br>TCGCCGTGGAGTGGGAGAGCAATGGGCAGCCGGAGAACA<br>ACTACAAGACCACGCCTCCCGTGCTGGACTCCGACGGCTC<br>CTTCTTCCTCGTGAGCAAGCTCACCGTGGACAAGAGCAGG<br>TGGCAGCAGGGGAACGTCTTCTCATGCTCCGTGATGCATG<br>AGGCTCTGCACAACCACTACACGCAGAAGAGCCTCTCCCT<br>GTCTCCGGGTGGAGGCGGCGGAAGCGGAGGAGGAGGATC<br>CGGCGGCGGAGGTTCCGGAGGCGGAGGATCCCAGGTGCA<br>GCTGGTGCAGTCTGGCGCCGAAGTGAAGAAACCCGGCAG<br>CAGCGTGAAGGTGTCCTGCAAGGCCAGCGGCTTCAACAT<br>CAAGGACACCTACATGCACTGGGTGCGCCAGGCCCCTGG<br>ACAGGGACTGGAATGGATGGGCAGAATCGACCCCGCCAA<br>CGGCAACAGCAAATACGTGCCCAAGTTCCAGGGCAGAGT<br>GACCATCACCGCCGACACCAGCACCTCCACCGCCTACATG<br>GAACTGAGCAGCCTGCGGAGCGAGGACACCGCCGTGTAC<br>TACTGTGCCCCCTTCGGCTACTACGTGTCCGACTACGCCA<br>TGGCCTATTGGGGCCAGGGCACACTCGTGACCGTGTCCTCT |
| 68 | VHCH1 (20H4.9)-Heavy chain knob-VL (T84.66-LCHA) (nucleotide sequence) | CAGGTGCAGCTGCAGCAGTGGGGAGCCGGCCTGCTGAAG<br>CCCAGCGAGACACTGAGCCTGACCTGCGCCGTGTACGGC<br>GGCAGCTTCAGCGGCTACTACTGGTCCTGGATCCGGCAGA<br>GCCCCGAGAAGGGCCTGGAATGGATCGGCGAGATCAACC<br>ACGGCGGCTACGTGACCTACAACCCCAGCCTGGAAAGCA<br>GAGTGACCATCAGCGTGGACACCAGCAAGAACCAGTTCA<br>GCCTGAAGCTGAGCAGCGTGACAGCCGCCGACACCGCCG<br>TGTACTACTGCGCCAGAGACTACGGCCCTGGCAACTACG<br>ACTGGTACTTCGACCTGTGGGGCAGAGGCACCCTGGTGA<br>CAGTGTCCAGCGCTAGCACCAAGGGCCCATCGGTCTTCCC<br>CCTGGCACCCTCCTCCAAGAGCACCTCTGGGGGCACAGC<br>GGCCCTGGGCTGCCTGGTCAAGGACTACTTCCCCGAACCG<br>GTGACGGTGTCGTGGAACTCAGGCGCCCTGACCAGCGGC<br>GTGCACACCTTCCCGGCTGTCCTACAGTCCTCAGGACTCT<br>ACTCCCTCAGCAGCGTGGTGACCGTGCCCTCCAGCAGCTT<br>GGGCACCCAGACCTACATCTGCAACGTGAATCACAAGCC<br>CAGCAACACCAAGGTGGACAAGAAAGTTGAGCCCAAATC<br>TTGTGACAAAACTCACACATGCCCACCGTGCCCAGCACCT<br>GAAGCTGCAGGGGACCGTCAGTCTTCCTCTTCCCCCCAA<br>AACCCAAGGACACCCTCATGATCTCCCGGACCCCTGAGGT<br>CACATGCGTGGTGGTGGACGTGAGCCACGAAGACCCTGA<br>GGTCAAGTTCAACTGGTACGTGGACGGCGTGGAGGTGCA<br>TAATGCCAAGACAAAGCCGCGGGAGGAGCAGTACAACAG<br>CACGTACCGTGTGGTCAGCGTCCTCACCGTCCTGCACCAG<br>GACTGGCTGAATGGCAAGGAGTACAAGTGCAAGGTCTCC<br>AACAAAGCCCTCGGCGCCCCCATCGAGAAAACCATCTCC |

TABLE 23-continued

Sequences of bispecific, bivalent anti-4-1BB/monovalent anti-CEA (T84.66-LCHA) human IgG1 P329GLALA antigen binding molecules (Constructs with a-CEA VH fused to Fc hole chain and VL fused to Fc knob chain, termed hole-VH)

| SEQ ID NO: | Description | Sequence |
|---|---|---|
| | | AAAGCCAAAGGGCAGCCCCGAGAACCACAGGTGTACACC CTGCCCCCCTGCAGAGATGAGCTGACCAAGAACCAGGTG TCCCTGTGGTGTCTGGTCAAGGGCTTCTACCCCAGCGATA TCGCCGTGGAGTGGGAGAGCAACGGCCAGCCTGAGAACA ACTACAAGACCACCCCCCCTGTGCTGGACAGCGACGGCA GCTTCTTCCTGTACTCCAAACTGACCGTGGACAAGAGCCG GTGGCAGCAGGGCAACGTGTTCAGCTGCAGCGTGATGCA CGAGGCCCTGCACAACCACTACACCCAGAAGTCCCTGAG CCTGAGCCCCGGCGGAGGCGGCGGAAGCGGAGGAGGAG GATCTGGGGCGGAGGTTCCGGAGGCGGTGGATCTGAGA TCGTGCTGACCCAGAGCCCTGCCACCCTGTCACTGTCTCC AGGCGAGAGAGCCACCCTGAGCTGTAGAGCCGGCGAGAG CGTGGACATCTTCGGCGTGGGATTTCTGCACTGGTATCAG CAGAAGCCCGGCCAGGCCCCCAGACTGCTGATCTACAGA GCCAGCAACGGGCCACAGGCATCCCCGCCAGATTTTCTG GCTCTGGCAGCGGCACCGACTTCACCCTGACAATCAGCA GCCTGGAACCCGAGGACTTCGCCGTGTACTACTGCCAGCA GACCAACGAGGACCCCTACACCTTTGGCCAGGGCACCAA GCTGGAAATCAAG |
| 43 | VLCL-Light chain (20H4.9) (nucleotide sequence) | see Table 1 |
| 69 | VHCH1 (20H4.9)-Heavy chain hole-VH (T84.66-LCHA) | QVQLQQWGAGLLKPSETLSLTCAVYGGSFSGYYWSWIRQS PEKGLEWIGEINHGGYVTYNPSLESRVTISVDTSKNQFSLKLS SVTAADTAVYYCARDYGPGNYDWYFDLWGRGTLVTVSSA STKGPSVFPLAPSSKSTSGGTAALGCLVKDYFPEPVTVSWNS GALTSGVHTFPAVLQSSGLYSLSSVVTVPSSSLGTQTYICNV NHKPSNTKVDKKVEPKSCDKTHTCPPCPAPEAAGGPSVFLFP PKPKDTLMISRTPEVTCVVVDVSHEDPEVKFNWYVDGVEV HNAKTKPREEQYNSTYRVVSVLTVLHQDWLNGKEYKCKVS NKALGAPIEKTISKAKGQPREPQVCTLPPSRDELTKNQVSLS CAVKGFYPSDIAVEWESNGQPENNYKTTPPVLDSDGSFFLVS KLTVDKSRWQQGNVFSCSVMHEALHNHYTQKSLSLSPGGG GGSGGGGSGGGGSGGGGSQVQLVQSGAEVKKPGSSVKVSC KASGFNIKDTYMHWVRQAPGQGLEWMGRIDPANGNSKYV PKFQGRVTITADTSTSTAYMELSSLRSEDTAVYYCAPFGYYV SDYAMAYWGQGTLVTVSS |
| 70 | VHCH1 (20H4.9)-Heavy chain knob-VL (T84.66-LCHA) | QVQLQQWGAGLLKPSETLSLTCAVYGGSFSGYYWSWIRQS PEKGLEWIGEINHGGYVTYNPSLESRVTISVDTSKNQFSLKLS SVTAADTAVYYCARDYGPGNYDWYFDLWGRGTLVTVSSA STKGPSVFPLAPSSKSTSGGTAALGCLVKDYFPEPVTVSWNS GALTSGVHTFPAVLQSSGLYSLSSVVTVPSSSLGTQTYICNV NHKPSNTKVDKKVEPKSCDKTHTCPPCPAPEAAGGPSVFLFP PKPKDTLMISRTPEVTCVVVDVSHEDPEVKFNWYVDGVEV HNAKTKPREEQYNSTYRVVSVLTVLHQDWLNGKEYKCKVS NKALGAPIEKTISKAKGQPREPQVYTLPPCRDELTKNQVSLW CLVKGFYPSDIAVEWESNGQPENNYKTTPPVLDSDGSFFLYS KLTVDKSRWQQGNVFSCSVMHEALHNHYTQKSLSLSPGGG GGSGGGGSGGGGSGGGGSEIVLTQSPATLSLSPGERATLSCR AGESVDIFGVGFLHWYQQKPGQAPRLLIYRASNRATGIPARF SGSGSGTDFTLTISSLEPEDFAVYYCQQTNEDPYTFGQGTKL EIK |
| 46 | VLCL-Light chain (20H4.9) | see Table 1 |

The base pair and amino acid sequences for 2+1 anti-4-1BB, anti-CEA constructs with a-CEA (A5B7) VH fused to the Fc knob heavy chain and VL fused to Fc hole heavy chain can be found respectively in Table 24. The molecule is termed 2+1 4-1BB (20H4.9)/CEA(A5B7) human IgG1 PGLALA $(G_4S)_4$, hole VL.

TABLE 24

Sequences of bispecific, bivalent anti-4-1BB/monovalent anti-CEA
(A5B7) human IgG1 P329GLALA antigen binding molecules
(Constructs with a-CEA VL fused to Fc hole chain and
VH fused to Fc knob chain, termed hole-VL)

| SEQ ID NO: | Description | Sequence |
|---|---|---|
| 71 | VHCH1 (20H4.9)-Heavy chain hole-VL (A5B7) (nucleotide sequence) | CAGGTGCAGCTGCAGCAGTGGGGAGCCGGCCTGCTGAAG<br>CCCAGCGAGACACTGAGCCTGACCTGCGCCGTGTACGGC<br>GGCAGCTTCAGCGGCTACTACTGGTCCTGGATCCGGCAGA<br>GCCCCGAGAAGGGCCTGGAATGGATCGGCGAGATCAACC<br>ACGGCGGCTACGTGACCTACAACCCCAGCCTGGAAAGCA<br>GAGTGACCATCAGCGTGGACACCAGCAAGAACCAGTTCA<br>GCCTGAAGCTGAGCAGCGTGACAGCCGCCGACACCGCCG<br>TGTACTACTGCGCCAGAGACTACGGCCCTGGCAACTACG<br>ACTGGTACTTCGACCTGTGGGGCAGAGGCACCCTGGTGA<br>CAGTGTCCAGCGCTAGCACCAAGGGCCCATCGGTCTTCC<br>CCTGGCACCCTCCTCCAAGAGCACCTCTGGGGGCACAGC<br>GGCCCTGGGCTGCCTGGTCAAGGACTACTTCCCCGAACCG<br>GTGACGGTGTCGTGGAACTCAGGCGCCCTGACCAGCGGC<br>GTGCACACCTTCCCGGCTGTCCTACAGTCCTCAGGACTCT<br>ACTCCCTCAGCAGCGTGGTGACCGTGCCCTCCAGCAGCTT<br>GGGCACCCAGACCTACATCTGCAACGTGAATCACAAGCC<br>CAGCAACACCAAGGTGGACAAGAAAGTTGAGCCCAAATC<br>TTGTGACAAAACTCACACATGCCCACCGTGCCCAGCACCT<br>GAAGCTGCAGGGGGACCGTCAGTCTTCCTCTTCCCCCCAA<br>AACCCAAGGACACCCTCATGATCTCCCGGACCCCTGAGGT<br>CACATGCGTGGTGGTGGACGTGAGCCACGAAGACCCTGA<br>GGTCAAGTTCAACTGGTACGTGGACGGCGTGGAGGTGCA<br>TAATGCCAAGACAAAGCCGCGGGAGGAGCAGTACAACAG<br>CACGTACCGTGTGGTCAGCGTCCTCACCGTCCTGCACCAG<br>GACTGGCTGAATGGCAAGGAGTACAAGTGCAAGGTCTCC<br>AACAAAGCCCTCGGCGCCCCCATCGAGAAAACCATCTCC<br>AAAGCCAAAGGGCAGCCCCGAGAACCACAGGTGTGCACC<br>CTGCCCCCATCCCGGGATGAGCTGACCAAGAACCAGGTC<br>AGCCTCTCGTGCGCAGTCAAAGGCTTCTATCCCAGCGACA<br>TCGCCGTGGAGTGGGAGAGCAATGGGCAGCCGGAGAACA<br>ACTACAAGACCACGCCTCCCGTGCTGGACTCCGACGGCTC<br>CTTCTTCCTCGTGAGCAAGCTCACCGTGGACAAGAGCAGG<br>TGGCAGCAGGGGAACGTCTTCTCATGCTCCGTGATGCATG<br>AGGCTCTGCACAACCACTACACGCAGAAGAGCCTCTCCCT<br>GTCTCCGGGTGGAGGCGGCGGAAGCGGAGGAGGAGGATC<br>CGGCGGCGGAGGTTCCGGAGGCGGAGGATCCCAGGCCGT<br>GCTGACACAGCCTGCCAGCCTGTCTGCTTCTCCTGGCGCC<br>TCTGCCTCCCTGACCTGCACACTGAGAAGAGGCATCAACG<br>TGGGCGCCTACAGCATCTACTGGTATCAGCAGAAGCCCG<br>GCAGCCCCCCTCAGTACCTGCTGAGATACAAGAGCGACA<br>GCGACAAGCAGCAGGGCAGCGGCGTGTCCAGCAGATTCA<br>GCGCCAGCAAGGACGCCTCTGCCAACGCCGGAATCCTGC<br>TGATCAGCGGCCTGCAGTCTGAGGACGAGGCCGACTACT<br>ACTGCATGATCTGGCACTCTGGCGCCAGCGCCGTGTTTGG<br>CGGAGGCACAAAACTGACCGTGCTG |
| 72 | VHCH1 (20H4.9)-Heavy chain knob-VH (A5B7) (nucleotide sequence) | CAGGTGCAGCTGCAGCAGTGGGGAGCCGGCCTGCTGAAG<br>CCCAGCGAGACACTGAGCCTGACCTGCGCCGTGTACGGC<br>GGCAGCTTCAGCGGCTACTACTGGTCCTGGATCCGGCAGA<br>GCCCCGAGAAGGGCCTGGAATGGATCGGCGAGATCAACC<br>ACGGCGGCTACGTGACCTACAACCCCAGCCTGGAAAGCA<br>GAGTGACCATCAGCGTGGACACCAGCAAGAACCAGTTCA<br>GCCTGAAGCTGAGCAGCGTGACAGCCGCCGACACCGCCG<br>TGTACTACTGCGCCAGAGACTACGGCCCTGGCAACTACG<br>ACTGGTACTTCGACCTGTGGGGCAGAGGCACCCTGGTGA<br>CAGTGTCCAGCGCTAGCACCAAGGGCCCATCGGTCTTCC<br>CCTGGCACCCTCCTCCAAGAGCACCTCTGGGGGCACAGC<br>GGCCCTGGGCTGCCTGGTCAAGGACTACTTCCCCGAACCG<br>GTGACGGTGTCGTGGAACTCAGGCGCCCTGACCAGCGGC<br>GTGCACACCTTCCCGGCTGTCCTACAGTCCTCAGGACTCT<br>ACTCCCTCAGCAGCGTGGTGACCGTGCCCTCCAGCAGCTT<br>GGGCACCCAGACCTACATCTGCAACGTGAATCACAAGCC<br>CAGCAACACCAAGGTGGACAAGAAAGTTGAGCCCAAATC<br>TTGTGACAAAACTCACACATGCCCACCGTGCCCAGCACCT<br>GAAGCTGCAGGGGGACCGTCAGTCTTCCTCTTCCCCCCAA<br>AACCCAAGGACACCCTCATGATCTCCCGGACCCCTGAGGT<br>CACATGCGTGGTGGTGGACGTGAGCCACGAAGACCCTGA<br>GGTCAAGTTCAACTGGTACGTGGACGGCGTGGAGGTGCA<br>TAATGCCAAGACAAAGCCGCGGGAGGAGCAGTACAACAG<br>CACGTACCGTGTGGTCAGCGTCCTCACCGTCCTGCACCAG<br>GACTGGCTGAATGGCAAGGAGTACAAGTGCAAGGTCTCC<br>AACAAAGCCCTCGGCGCCCCCATCGAGAAAACCATCTCC |

TABLE 24-continued

Sequences of bispecific, bivalent anti-4-1BB/monovalent anti-CEA
(A5B7) human IgG1 P329GLALA antigen binding molecules
(Constructs with a-CEA VL fused to Fc hole chain and
VH fused to Fc knob chain, termed hole-VL)

| SEQ ID NO: | Description | Sequence |
|---|---|---|
| | | AAAGCCAAAGGGCAGCCCCGAGAACCACAGGTGTACACC CTGCCCCCCTGCAGAGATGAGCTGACCAAGAACCAGGTG TCCCTGTGGTGTCTGGTCAAGGGCTTCTACCCCAGCGATA TCGCCGTGGAGTGGGAGAGCAACGGCCAGCCTGAGAACA ACTACAAGACCACCCCCCCTGTGCTGGACAGCGACGGCA GCTTCTTCCTGTACTCCAAACTGACCGTGGACAAGAGCCG GTGGCAGCAGGGCAACGTGTTCAGCTGCAGCGTGATGCA CGAGGCCCTGCACAACCACTACACCCAGAAGTCCCTGAG CCTGAGCCCCGGCGAGGCGGCGGAAGCGGAGGAGGAG GATCTGGGGCGGAGGTTCCGGAGGCGGTGGATCTGAAG TGCAGCTGGTGGAATCTGGCGGCGGACTGGTGCAGCCTG GCAGAAGCCTGAGACTGAGCTGTGCCGCCAGCGGCTTTA CCGTGTCCAGCTACTGGATGCACTGGGTCCGACAGGCCCC TGGCAAGGGACTGGAATGGGTCGGATTCATCAGAAACAA GGCCAACGGCGGCACCACCGAGTACGCCGCCTCTGTGAA GGGCCGGTTCACCATCAGCGGGACGACAGCAAGAACAC CCTGTACCTGCAGATGAACAGCCTGCGGGCCGAGGACAC CGCCGTGTACTACTGCGCCAGAGACAGAGGCCTGCGGTT CTACTTCGACTACTGGGGCCAGGGCACCACCGTGACAGTC TCTTCC |
| 43 | VLCL-Light chain (20H4.9) (nucleotide sequence) | see Table 1 |
| 73 | VHCH1 (20H4.9)-Heavy chain hole-VL (A5B7) | QVQLQQWGAGLLKPSETLSLTCAVYGGSFSGYYWSWIRQS PEKGLEWIGEINHGGYVTYNPSLESRVTISVDTSKNQFSLKLS SVTAADTAVYYCARDYGPGNYDWYFDLWGRGTLVTVSSA STKGPSVFPLAPSSKSTSGGTAALGCLVKDYFPEPVTVSWNS GALTSGVHTFPAVLQSSGLYSLSSVVTVPSSSLGTQTYICNV NHKPSNTKVDKKVEPKSCDKTHTCPPCPAPEAAGGPSVFLFP PKPKDTLMISRTPEVTCVVVDVSHEDPEVKFNWYVDGVEV HNAKTKPREEQYNSTYRVVSVLTVLHQDWLNGKEYKCKVS NKALGAPIEKTISKAKGQPREPQVCTLPPSRDELTKNQVSLS CAVKGFYPSDIAVEWESNGQPENNYKTTPPVLDSDGSFFLVS KLTVDKSRWQQGNVFSCSVMHEALHNHYTQKSLSLSPGGG GGSGGGGSGGGGSGGGGSQAVLTQPASLSASPGASASLTCT LRRGINVGAYSIYWYQQKPGSPPQYLLRYKSDSDKQQGSGV SSRFSASKDASANAGILLISGLQSEDEADYYCMIWHSGASAV FGGGTKLTVL |
| 74 | VHCH1 (20H4.9)-Heavy chain knob-VH (A5B7) | QVQLQQWGAGLLKPSETLSLTCAVYGGSFSGYYWSWIRQS PEKGLEWIGEINHGGYVTYNPSLESRVTISVDTSKNQFSLKLS SVTAADTAVYYCARDYGPGNYDWYFDLWGRGTLVTVSSA STKGPSVFPLAPSSKSTSGGTAALGCLVKDYFPEPVTVSWNS GALTSGVHTFPAVLQSSGLYSLSSVVTVPSSSLGTQTYICNV NHKPSNTKVDKKVEPKSCDKTHTCPPCPAPEAAGGPSVFLFP PKPKDTLMISRTPEVTCVVVDVSHEDPEVKFNWYVDGVEV HNAKTKPREEQYNSTYRVVSVLTVLHQDWLNGKEYKCKVS NKALGAPIEKTISKAKGQPREPQVYTLPPCRDELTKNQVSLW CLVKGFYPSDIAVEWESNGQPENNYKTTPPVLDSDGSFFLYS KLTVDKSRWQQGNVFSCSVMHEALHNHYTQKSLSLSPGGG GGSGGGGSGGGGSGGGGSEVQLVESGGGLVQPGRSLRLSC AASGFTVSSYWMHWVRQAPGKGLEWVGFIRNKANGGTTE YAASVKGRFTISRDDSKNTLYLQMNSLRAEDTAVYYCARD RGLRFYFDYWGQGTTVTVSS |
| 46 | VLCL-Light chain (20H4.9) | see Table 1 |

The base pair and amino acid sequences for 2+1 anti-4-1BB, anti-CEA (A5B7) constructs with a-CEA (A5B7) VL fused to the Fc knob heavy chain and VH fused to Fc hole heavy chain can be found respectively in Table 25. The molecule is termed 2+1 4-1BB (20H4.9)/CEA(A5B7) human IgG1 PGLALA (G$_4$S)$_4$, hole VH.

TABLE 25

Sequences of bispecific, bivalent anti-4-1BB/monovalent
anti-CEA (A5B7) human IgG1 P329GLALA antigen binding molecules
(Constructs with a-CEA VH fused to Fc hole chain and VL
fused to Fc knob chain, termed hole-VH)

| SEQ ID NO: | Description | Sequence |
|---|---|---|
| 75 | VHCH1 (20H4.9)-Heavy chain hole-VH (A5B7) (nucleotide sequence) | CAGGTGCAGCTGCAGCAGTGGGGAGCCGGCCTGCTGAAG CCCAGCGAGACACTGAGCCTGACCTGCGCCGTGTACGGC GGCAGCTTCAGCGGCTACTACTGGTCCTGGATCCGGCAGA GCCCCGAGAAGGGCCTGGAATGGATCGGCGAGATCAACC ACGGCGGCTACGTGACCTACAACCCCAGCCTGGAAAGCA GAGTGACCATCAGCGTGGACACCAGCAAGAACCAGTTCA GCCTGAAGCTGAGCAGCGTGACAGCCGCCGACACCGCCG TGTACTACTGCGCCAGAGACTACGGCCCTGGCAACTACG ACTGGTACTTCGACCTGTGGGGCAGAGGCACCCTGGTGA CAGTGTCCAGCGCTAGCACCAAGGGCCCATCGGTCTTCCC CCTGGCACCCTCCTCCAAGAGCACCTCTGGGGGCACAGC GGCCCTGGGCTGCCTGGTCAAGGACTACTTCCCCGAACCG GTGACGGTGTCGTGGAACTCAGGCGCCCTGACCAGCGGC GTGCACACCTTCCCGGCTGTCCTACAGTCCTCAGGACTCT ACTCCCTCAGCAGCGTGGTGACCGTGCCCTCCAGCAGCTT GGGCACCCAGACCTACATCTGCAACGTGAATCACAAGCC CAGCAACACCAAGGTGGACAAGAAAGTTGAGCCCAAATC TTGTGACAAAACTCACACATGCCCACCGTGCCCAGCACCT GAAGCTGCAGGGGGACCGTCAGTCTTCCTCTTCCCCCCAA AACCCAAGGACACCCTCATGATCTCCCGGACCCCTGAGGT CACATGCGTGGTGGTGGACGTGAGCCACGAAGACCCTGA GGTCAAGTTCAACTGGTACGTGGACGGCGTGGAGGTGCA TAATGCCAAGACAAAGCCGCGGGAGGAGCAGTACAACAG CACGTACCGTGTGGTCAGCGTCCTCACCGTCCTGCACCAG GACTGGCTGAATGGCAAGGAGTACAAGTGCAAGGTCTCC AACAAAGCCCTCGGCGCCCCCATCGAGAAAACCATCTCC AAAGCCAAAGGGCAGCCCCGAGAACCACAGGTGTGCACC CTGCCCCCATCCCGGGATGAGCTGACCAAGAACCAGGTC AGCCTCTCGTGCGCAGTCAAAGGCTTCTATCCCAGCGACA TCGCCGTGGAGTGGGAGAGCAATGGGCAGCCGGAGAACA ACTACAAGACCACGCCTCCCGTGCTGGACTCCGACGGCTC CTTCTTCCTCGTGAGCAAGCTCACCGTGGACAAGAGCAGG TGGCAGCAGGGGAACGTCTTCTCATGCTCCGTGATGCATG AGGCTCTGCACAACCACTACACGCAGAAGAGCCTCTCCCT GTCTCCGGGTGGAGGCGGCGGAAGCGGAGGAGGAGGATC CGGCGGCGGAGGTTCCGGAGGCGGAGGATCCGAAGTGCA GCTGGTGGAATCTGGCGGCGACTGGTGCAGCCTGGCAG AAGCCTGAGACTGAGCTGTGCCGCCAGCGGCTTTACCGTG TCCAGCTACTGGATGCACTGGGTCCGACAGGCCCCTGGCA AGGGACTGGAATGGGTCGGATTCATCAGAAACAAGGCCA ACGGCGGCACCACCGAGTACGCCGCCTCTGTGAAGGGCC GGTTCACCATCAGCCGGGACGACAGCAAGAACACCCTGT ACCTGCAGATGAACAGCCTGCGGGCCGAGGACACCGCCG TGTACTACTGCGCCAGAGACAGAGGCCTGCGGTTCTACTT CGACTACTGGGGCCAGGGCACCACCGTGACAGTCTCTTCC |
| 76 | VHCH1 (20H4.9)-Heavy chain knob-VL (A5B7) (nucleotide sequence) | CAGGTGCAGCTGCAGCAGTGGGGAGCCGGCCTGCTGAAG CCCAGCGAGACACTGAGCCTGACCTGCGCCGTGTACGGC GGCAGCTTCAGCGGCTACTACTGGTCCTGGATCCGGCAGA GCCCCGAGAAGGGCCTGGAATGGATCGGCGAGATCAACC ACGGCGGCTACGTGACCTACAACCCCAGCCTGGAAAGCA GAGTGACCATCAGCGTGGACACCAGCAAGAACCAGTTCA GCCTGAAGCTGAGCAGCGTGACAGCCGCCGACACCGCCG TGTACTACTGCGCCAGAGACTACGGCCCTGGCAACTACG ACTGGTACTTCGACCTGTGGGGCAGAGGCACCCTGGTGA CAGTGTCCAGCGCTAGCACCAAGGGCCCATCGGTCTTCCC CCTGGCACCCTCCTCCAAGAGCACCTCTGGGGGCACAGC GGCCCTGGGCTGCCTGGTCAAGGACTACTTCCCCGAACCG GTGACGGTGTCGTGGAACTCAGGCGCCCTGACCAGCGGC GTGCACACCTTCCCGGCTGTCCTACAGTCCTCAGGACTCT ACTCCCTCAGCAGCGTGGTGACCGTGCCCTCCAGCAGCTT GGGCACCCAGACCTACATCTGCAACGTGAATCACAAGCC CAGCAACACCAAGGTGGACAAGAAAGTTGAGCCCAAATC TTGTGACAAAACTCACACATGCCCACCGTGCCCAGCACCT GAAGCTGCAGGGGGACCGTCAGTCTTCCTCTTCCCCCCAA AACCCAAGGACACCCTCATGATCTCCCGGACCCCTGAGGT CACATGCGTGGTGGTGGACGTGAGCCACGAAGACCCTGA GGTCAAGTTCAACTGGTACGTGGACGGCGTGGAGGTGCA TAATGCCAAGACAAAGCCGCGGGAGGAGCAGTACAACAG CACGTACCGTGTGGTCAGCGTCCTCACCGTCCTGCACCAG GACTGGCTGAATGGCAAGGAGTACAAGTGCAAGGTCTCC AACAAAGCCCTCGGCGCCCCCATCGAGAAAACCATCTCC |

TABLE 25-continued

Sequences of bispecific, bivalent anti-4-1BB/monovalent
anti-CEA (A5B7) human IgG1 P329GLALA antigen binding molecules
(Constructs with a-CEA VH fused to Fc hole chain and VL
fused to Fc knob chain, termed hole-VH)

| SEQ ID NO: | Description | Sequence |
|---|---|---|
| | | AAAGCCAAAGGGCAGCCCCGAGAACCACAGGTGTACACC<br>CTGCCCCCCTGCAGAGATGAGCTGACCAAGAACCAGGTG<br>TCCCTGTGGTGTCTGGTCAAGGGCTTCTACCCCAGCGATA<br>TCGCCGTGGAGTGGGAGAGCAACGGCCAGCCTGAGAACA<br>ACTACAAGACCACCCCCCCTGTGCTGGACAGCGACGGCA<br>GCTTCTTCCTGTACTCCAAACTGACCGTGGACAAGAGCCG<br>GTGGCAGCAGGGCAACGTGTTCAGCTGCAGCGTGATGCA<br>CGAGGCCCTGCACAACCACTACACCCAGAAGTCCCTGAG<br>CCTGAGCCCCGGCGGAGGCGGCGGAAGCGGAGGAGGAG<br>GATCTGGGGCGGAGGTTCCGGAGGCGGTGGATCTCAGG<br>CCGTGCTGACACAGCCTGCCAGCCTGTCTGCTTCTCCTGG<br>CGCCTCTGCCTCCCTGACCTGCACACTGAGAAGAGGCATC<br>AACGTGGGCGCCTACAGCATCTACTGGTATCAGCAGAAG<br>CCCGGCAGCCCCCCTCAGTACCTGCTGAGATACAAGAGC<br>GACAGCGACAAGCAGCAGGGCAGCGGCGTGTCCAGCAGA<br>TTCAGCGCCAGCAAGGACGCCTCTGCCAACGCCGGAATC<br>CTGCTGATCAGCGGCCTGCAGTCTGAGGACGAGGCCGAC<br>TACTACTGCATGATCTGGCACTCTGGCGCCAGCGCCGTGT<br>TTGGCGGAGGCACAAAACTGACCGTGCTG |
| 43 | VLCL-Light chain (20H4.9) (nucleotide sequence) | see Table 1 |
| 77 | VHCH1 (20H4.9)-Heavy chain hole-VH (A5B7) | QVQLQQWGAGLLKPSETLSLTCAVYGGSFSGYYWSWIRQS<br>PEKGLEWIGEINHGGYVTYNPSLESRVTISVDTSKNQFSLKLS<br>SVTAADTAVYYCARDYGPGNYDWYFDLWGRGTLVTVSSA<br>STKGPSVFPLAPSSKSTSGGTAALGCLVKDYFPEPVTVSWNS<br>GALTSGVHTFPAVLQSSGLYSLSSVVTVPSSSLGTQTYICNV<br>NHKPSNTKVDKKVEPKSCDKTHTCPPCPAPEAAGGPSVFLFP<br>PKPKDTLMISRTPEVTCVVVDVSHEDPEVKFNWYVDGVEV<br>HNAKTKPREEQYNSTYRVVSVLTVLHQDWLNGKEYKCKVS<br>NKALGAPIEKTISKAKGQPREPQVCTLPPSRDELTKNQVSLS<br>CAVKGFYPSDIAVEWESNGQPENNYKTTPPVLDSDGSFFLVS<br>KLTVDKSRWQQGNVFSCSVMHEALHNHYTQKSLSLSPGGG<br>GGSGGGGSGGGGSGGGGSEVQLVESGGGLVQPGRSLRLSC<br>AASGFTVSSYWMHWVRQAPGKGLEWVGFIRNKANGGTTE<br>YAASVKGRFTISRDDSKNTLYLQMNSLRAEDTAVYYCARD<br>RGLRFYFDYWGQGTTVTVSS |
| 78 | VHCH1 (20H4.9)-Heavy chain knob-VL (A5B7) | QVQLQQWGAGLLKPSETLSLTCAVYGGSFSGYYWSWIRQS<br>PEKGLEWIGEINHGGYVTYNPSLESRVTISVDTSKNQFSLKLS<br>SVTAADTAVYYCARDYGPGNYDWYFDLWGRGTLVTVSSA<br>STKGPSVFPLAPSSKSTSGGTAALGCLVKDYFPEPVTVSWNS<br>GALTSGVHTFPAVLQSSGLYSLSSVVTVPSSSLGTQTYICNV<br>NHKPSNTKVDKKVEPKSCDKTHTCPPCPAPEAAGGPSVFLFP<br>PKPKDTLMISRTPEVTCVVVDVSHEDPEVKFNWYVDGVEV<br>HNAKTKPREEQYNSTYRVVSVLTVLHQDWLNGKEYKCKVS<br>NKALGAPIEKTISKAKGQPREPQVYTLPPCRDELTKNQVSLW<br>CLVKGFYPSDIAVEWESNGQPENNYKTTPPVLDSDGSFFLYS<br>KLTVDKSRWQQGNVFSCSVMHEALHNHYTQKSLSLSPGGG<br>GGSGGGGSGGGGSGGGGSQAVLTQPASLSASPGASASLTCT<br>LRRGINVGAYSIYWYQQKPGSPPQYLLRYKSDSDKQQGSGV<br>SSRFSASKDASANAGILLISGLQSEDEADYYCMIWHSGASAV<br>FGGGTKLTVL |
| 46 | VLCL-Light chain (20H4.9) | see Table 1 |

The amino acid sequences for 2+1 anti-4-1BB, anti-CEA constructs with a-CEA (A5B7) VH fused to the Fc knob heavy chain and VL fused to Fc hole heavy chain can be found respectively in Table 26. The molecule is termed 2+1 4-1BB (20H4.9)/CEA(A5B7) human IgG1 PGLALA $(G_4S)_2$, hole VL.

TABLE 26

Sequences of bispecific, bivalent anti-4-1BB/monovalent anti-CEA (A5B7) human IgG1 P329GLALA antigen binding molecules (Constructs with a-CEA VL fused to Fc hole chain and VH fused to Fc knob chain, termed hole-VL)

| SEQ ID NO: | Description | Sequence |
|---|---|---|
| 137 | VHCH1 (20H4.9)-Heavy chain hole-VL (A5B7) (G4S)2 | QVQLQQWGAGLLKPSETLSLTCAVYGGSFSGYYWSWIRQS PEKGLEWIGEINHGGYVTYNPSLESRVTISVDTSKNQFSLKLS SVTAADTAVYYCARDYGPGNYDWYFDLWGRGTLVTVSSA STKGPSVFPLAPSSKSTSGGTAALGCLVKDYFPEPVTVSWNS GALTSGVHTFPAVLQSSGLYSLSSVVTVPSSSLGTQTYICNV NHKPSNTKVDKKVEPKSCDKTHTCPPCPAPEAAGGPSVFLFP PKPKDTLMISRTPEVTCVVVDVSHEDPEVKFNWYVDGVEV HNAKTKPREEQYNSTYRVVSVLTVLHQDWLNGKEYKCKVS NKALGAPIEKTISKAKGQPREPQVCTLPPSRDELTKNQVSLS CAVKGFYPSDIAVEWESNGQPENNYKTTPPVLDSDGSFFLVS KLTVDKSRWQQGNVFSCSVMHEALHNHYTQKSLSLSPGGG GGSGGGGSQAVLTQPASLSASPGASASLTCTLRRGINVGAYS IYWYQQKPGSPPQYLLRYKSDSDKQQGSGVSSRFSASKDAS ANAGILLISGLQSEDEADYYCMIWHSGASAVFGGGTKLTVL |
| 74 | VHCH1 (20H4.9)-Heavy chain knob-VH (A5B7) | see TABLE 24 |
| 46 | VLCL-Light chain (20H4.9) | see Table 1 |

The amino acid sequences for 2+1 anti-4-1BB, anti-CEA (A5B7) constructs with a-CEA (A5B7) VL fused to the Fc knob heavy chain and VH fused to Fc hole heavy chain can be found respectively in Table 27. The molecule is termed 2+1 4-1BB (20H4.9)/CEA(A5B7) human IgG1 PGLALA (G4S)2, hole VH.

Further examples were prepared with the murine CEA clone A5B7P (as further described in WO 92/01059) and the CEA clone 431/26 (as further described in EP 501215 A2). The amino acid sequences for 2+1 anti-4-1BB, anti-CEA constructs with the parental a-CEA (A5B7P) VH fused to the Fc knob heavy chain and VL fused to Fc hole heavy chain can be found respectively in Table 28. The molecule is termed 2+1 4-1BB (20H4.9)/CEA(A5B7P) human IgG1 PGLALA, hole VL.

TABLE 27

Sequences of bispecific, bivalent anti-4-1BB/monovalent anti-CEA (A5B7) human IgG1 P329GLALA antigen binding molecules (Constructs with a-CEA VH fused to Fc hole chain and VL fused to Fc knob chain, termed hole-VH)

| SEQ ID NO: | Description | Sequence |
|---|---|---|
| 138 | VHCH1 (20H4.9)-Heavy chain hole-VH (A5B7) (G4S)2 | QVQLQQWGAGLLKPSETLSLTCAVYGGSFSGYYWSWIRQS PEKGLEWIGEINHGGYVTYNPSLESRVTISVDTSKNQFSLKLS SVTAADTAVYYCARDYGPGNYDWYFDLWGRGTLVTVSSA STKGPSVFPLAPSSKSTSGGTAALGCLVKDYFPEPVTVSWNS GALTSGVHTFPAVLQSSGLYSLSSVVTVPSSSLGTQTYICNV NHKPSNTKVDKKVEPKSCDKTHTCPPCPAPEAAGGPSVFLFP PKPKDTLMISRTPEVTCVVVDVSHEDPEVKFNWYVDGVEV HNAKTKPREEQYNSTYRVVSVLTVLHQDWLNGKEYKCKVS NKALGAPIEKTISKAKGQPREPQVCTLPPSRDELTKNQVSLS CAVKGFYPSDIAVEWESNGQPENNYKTTPPVLDSDGSFFLVS KLTVDKSRWQQGNVFSCSVMHEALHNHYTQKSLSLSPGGG GGSGGGGSEVQLVESGGGLVQPGRSLRLSCAASGFTVSSYW MHWVRQAPGKGLEWVGFIRNKANGGTTEYAASVKGRFTIS RDDSKNTLYLQMNSLRAEDTAVYYCARDRGLRFYFDYWG QGTTVTVSS |
| 78 | VHCH1 (20H4.9)-Heavy chain knob-VL (A5B7) | see Table 25 |
| 46 | VLCL-Light chain (20H4.9) | see Table 1 |

TABLE 28

Sequences of bispecific, bivalent anti-4-1BB/monovalent anti-CEA (A5B7P) human IgG1 P329GLALA antigen binding molecules (Constructs with a-CEA VL fused to Fc hole chain and VH fused to Fc knob chain, termed $(G_4S)_4$ hole-VL)

| SEQ ID NO: | Description | Sequence |
|---|---|---|
| 195 | VHCH1 (20H4.9)-Heavy chain hole-VL (A5B7P) | QVQLQQWGAGLLKPSETLSLTCAVYGGSFSGYYWSWIRQS PEKGLEWIGEINHGGYVTYNPSLESRVTISVDTSKNQFSLKLS SVTAADTAVYYCARDYGPGNYDWYFDLWGRGTLVTVSSA STKGPSVFPLAPSSKSTSGGTAALGCLVKDYFPEPVTVSWNS GALTSGVHTFPAVLQSSGLYSLSSVVTVPSSSLGTQTYICNV NHKPSNTKVDKKVEPKSCDKTHTCPPCPAPEAAGGPSVFLFP PKPKDTLMISRTPEVTCVVVDVSHEDPEVKFNWYVDGVEV HNAKTKPREEQYNSTYRVVSVLTVLHQDWLNGKEYKCKVS NKALGAPIEKTISKAKGQPREPQVCTLPPSRDELTKNQVSLS CAVKGFYPSDIAVEWESNGQPENNYKTTPPVLDSDGSFFLVS KLTVDKSRWQQGNVFSCSVMHEALHNHYTQKSLSLSPGGG GGSGGGGSGGGGSGGGGSQTVLSQSPAILSASPGEKVTMTC RASSSVTYIHWYQQKPGSSPKSWIYATSNLASGVPARFSGSG SGTSYSLTISRVEAEDAATYYCQHWSSKPPTFGGGTKLEIK |
| 196 | VHCH1 (20H4.9)-Heavy chain knob-VH (A5B7P) | QVQLQQWGAGLLKPSETLSLTCAVYGGSFSGYYWSWIRQS PEKGLEWIGEINHGGYVTYNPSLESRVTISVDTSKNQFSLKLS SVTAADTAVYYCARDYGPGNYDWYFDLWGRGTLVTVSSA STKGPSVFPLAPSSKSTSGGTAALGCLVKDYFPEPVTVSWNS GALTSGVHTFPAVLQSSGLYSLSSVVTVPSSSLGTQTYICNV NHKPSNTKVDKKVEPKSCDKTHTCPPCPAPEAAGGPSVFLFP PKPKDTLMISRTPEVTCVVVDVSHEDPEVKFNWYVDGVEV HNAKTKPREEQYNSTYRVVSVLTVLHQDWLNGKEYKCKVS NKALGAPIEKTISKAKGQPREPQVYTLPPCRDELTKNQVSLW CLVKGFYPSDIAVEWESNGQPENNYKTTPPVLDSDGSFFLYS KLTVDKSRWQQGNVFSCSVMHEALHNHYTQKSLSLSPGGG GGSGGGGSGGGGSGGGGSEVKLVESGGGLVQPGGSLRLSC ATSGFTFTDYYMNWVRQPPGKALEWLGFIGNKANGYTTEY SASVKGRFTISRDKSQSILYLQMNTLRAEDSATYYCTRDRGL RFYFDYWGQGTTLTVSS |
| 46 | VLCL-Light chain (20H4.9) | see Table 1 |

The amino acid sequences for 2+1 anti-4-1BB, anti-CEA (A5B7P) constructs with a-CEA (A5B7P) VL fused to the Fc knob heavy chain and VH fused to Fc hole heavy chain can be found respectively in Table 29. The molecule is termed 2+1 4-1BB (20H4.9)/CEA(A5B7P) human IgG1 PGLALA, $(G_4S)_4$ hole VH.

TABLE 29

Sequences of bispecific, bivalent anti-4-1BB/monovalent anti-CEA (A5B7P) human IgG1 P329GLALA antigen binding molecules (Constructs with a-CEA VH fused to Fc hole chain and VL fused to Fc knob chain, termed hole-VH)

| SEQ ID NO: | Description | Sequence |
|---|---|---|
| 197 | VHCH1 (20H4.9)-Heavy chain hole-VH (A5B7P) | QVQLQQWGAGLLKPSETLSLTCAVYGGSFSGYYWSWIRQS PEKGLEWIGEINHGGYVTYNPSLESRVTISVDTSKNQFSLKLS SVTAADTAVYYCARDYGPGNYDWYFDLWGRGTLVTVSSA STKGPSVFPLAPSSKSTSGGTAALGCLVKDYFPEPVTVSWNS GALTSGVHTFPAVLQSSGLYSLSSVVTVPSSSLGTQTYICNV NHKPSNTKVDKKVEPKSCDKTHTCPPCPAPEAAGGPSVFLFP PKPKDTLMISRTPEVTCVVVDVSHEDPEVKFNWYVDGVEV HNAKTKPREEQYNSTYRVVSVLTVLHQDWLNGKEYKCKVS NKALGAPIEKTISKAKGQPREPQVCTLPPSRDELTKNQVSLS CAVKGFYPSDIAVEWESNGQPENNYKTTPPVLDSDGSFFLVS KLTVDKSRWQQGNVFSCSVMHEALHNHYTQKSLSLSPGGG GGSGGGGSGGGGSGGGGSEVKLVESGGGLVQPGGSLRLSC ATSGFTFTDYYMNWVRQPPGKALEWLGFIGNKANGYTTEY SASVKGRFTISRDKSQSILYLQMNTLRAEDSATYYCTRDRGL RFYFDYWGQGTTLTVSS |
| 198 | VHCH1 (20H4.9)-Heavy chain knob-VL (A5B7P) | QVQLQQWGAGLLKPSETLSLTCAVYGGSFSGYYWSWIRQS PEKGLEWIGEINHGGYVTYNPSLESRVTISVDTSKNQFSLKLS SVTAADTAVYYCARDYGPGNYDWYFDLWGRGTLVTVSSA STKGPSVFPLAPSSKSTSGGTAALGCLVKDYFPEPVTVSWNS GALTSGVHTFPAVLQSSGLYSLSSVVTVPSSSLGTQTYICNV NHKPSNTKVDKKVEPKSCDKTHTCPPCPAPEAAGGPSVFLFP |

TABLE 29 -continued

Sequences of bispecific, bivalent anti-4-1BB/monovalent anti-CEA (A5B7P)
human IgG1 P329GLALA antigen binding molecules (Constructs with a-CEA
VH fused to Fc hole chain and VL fused to Fc knob chain, termed hole-VH)

| SEQ ID NO: | Description | Sequence |
|---|---|---|
| | | PKPKDTLMISRTPEVTCVVVDVSHEDPEVKFNWYVDGVEV HNAKTKPREEQYNSTYRVVSVLTVLHQDWLNGKEYKCKVS NKALGAPIEKTISKAKGQPREPQVYTLPPCRDELTKNQVSLW CLVKGFYPSDIAVEWESNGQPENNYKTTPPVLDSDGSFFLYS KLTVDKSRWQQGNVFSCSVMHEALHNHYTQKSLSLSPGGG GGSGGGGSGGGGSGGGGSQTVLSQSPAILSASPGEKVTMTC RASSSVTYIHWYQQKPGSSPKSWIYATSNLASGVPARFSGSG SGTSYSLTISRVEAEDAATYYCQHWSSKPPTFGGGTKLEIK |
| 46 | VLCL-Light chain (20H4.9) | see Table 1 |

The amino acid sequences for 2+1 anti-4-1BB, anti-CEA constructs with a-CEA (431/26) VH fused to the Fc knob heavy chain and VL fused to Fc hole heavy chain can be found respectively in Table 30. The molecule is termed 2+1 4-1BB (20H4.9)/CEA(431/26) human IgG1 PGLALA, (G$_4$S)$_4$, hole VL.

The amino acid sequences for 2+1 anti-4-1BB, anti-CEA (431/26) constructs with a-CEA (A5B7P) VL fused to the Fc knob heavy chain and VH fused to Fc hole heavy chain can be found respectively in Table 31. The molecule is termed 2+1 4-1BB (20H4.9)/CEA(431/26) human IgG1 PGLALA, (G$_4$S)$_4$, hole VH.

TABLE 30

Sequences of bispecific, bivalent anti-4-1BB/monovalent anti-CEA (431/26)
human IgG1 P329GLALA antigen binding molecules (Constructs with a-CEA
VL fused to Fc hole chain and VH fused to Fc knob chain, termed hole-VL)

| SEQ ID NO: | Description | Sequence |
|---|---|---|
| 199 | VHCH1 (20H4.9)-Heavy chain hole-VL (431/26) | QVQLQQWGAGLLKPSETLSLTCAVYGGSFSGYYWSWIRQS PEKGLEWIGEINHGGYVTYNPSLESRVTISVDTSKNQFSLKLS SVTAADTAVYYCARDYGPGNYDWYFDLWGRGTLVTVSSA STKGPSVFPLAPSSKSTSGGTAALGCLVKDYFPEPVTVSWNS GALTSGVHTFPAVLQSSGLYSLSSVVTVPSSSLGTQTYICNV NHKPSNTKVDKKVEPKSCDKTHTCPPCPAPEAAGGPSVFLFP PKPKDTLMISRTPEVTCVVVDVSHEDPEVKFNWYVDGVEV HNAKTKPREEQYNSTYRVVSVLTVLHQDWLNGKEYKCKVS NKALGAPIEKTISKAKGQPREPQVCTLPPSRDELTKNQVSLS CAVKGFYPSDIAVEWESNGQPENNYKTTPPVLDSDGSFFLVS KLTVDKSRWQQGNVFSCSVMHEALHNHYTQKSLSLSPGGG GGSGGGGSGGGGSGGGGSDIQMTQSPSSLSASVGDRVTITCS TSSSVSYMHWYQQKPGKAPKLLIYSTSNLASGVPSRFSGSGS GTDFTFTISSLQPEDIATYYCHQWSSYPTFGQGTKVEIK |
| 200 | VHCH1 (20H4.9)-Heavy chain knob-VH (431/26) | QVQLQQWGAGLLKPSETLSLTCAVYGGSFSGYYWSWIRQS PEKGLEWIGEINHGGYVTYNPSLESRVTISVDTSKNQFSLKLS SVTAADTAVYYCARDYGPGNYDWYFDLWGRGTLVTVSSA STKGPSVFPLAPSSKSTSGGTAALGCLVKDYFPEPVTVSWNS GALTSGVHTFPAVLQSSGLYSLSSVVTVPSSSLGTQTYICNV NHKPSNTKVDKKVEPKSCDKTHTCPPCPAPEAAGGPSVFLFP PKPKDTLMISRTPEVTCVVVDVSHEDPEVKFNWYVDGVEV HNAKTKPREEQYNSTYRVVSVLTVLHQDWLNGKEYKCKVS NKALGAPIEKTISKAKGQPREPQVYTLPPCRDELTKNQVSLW CLVKGFYPSDIAVEWESNGQPENNYKTTPPVLDSDGSFFLYS KLTVDKSRWQQGNVFSCSVMHEALHNHYTQKSLSLSPGGG GGSGGGGSGGGGSGGGGSQVQLQESGPGLVRPSQTLSLTCT VSGFTISSGYSWHWVRQPPGRGLEWIGYIQYSGITNYNPSLK SRVTMLVDTSKNQFSLRLSSVTAADTAVYYCAREDYDYHW YFDVWGQGSLVTVSS |
| 46 | VLCL-Light chain (20H4.9) | see Table 1 |

TABLE 31

Sequences of bispecific, bivalent anti-4-1BB/monovalent anti-CEA (431/26) human IgG1 P329GLALA antigen binding molecules (Constructs with a-CEA VH fused to Fc hole chain and VL fused to Fc knob chain, termed hole-VH)

| SEQ ID NO: | Description | Sequence |
|---|---|---|
| 201 | VHCH1 (20H4.9)-Heavy chain hole-VH (431/26) | QVQLQQWGAGLLKPSETLSLTCAVYGGSFSGYYWSWIRQS PEKGLEWIGEINHGGYVTYNPSLESRVTISVDTSKNQFSLKLS SVTAADTAVYYCARDYGPGNYDWYFDLWGRGTLVTVSSA STKGPSVFPLAPSSKSTSGGTAALGCLVKDYFPEPVTVSWNS GALTSGVHTFPAVLQSSGLYSLSSVVTVPSSSLGTQTYICNV NHKPSNTKVDKKVEPKSCDKTHTCPPCPAPEAAGGPSVFLFP PKPKDTLMISRTPEVTCVVVDVSHEDPEVKFNWYVDGVEV HNAKTKPREEQYNSTYRVVSVLTVLHQDWLNGKEYKCKVS NKALGAPIEKTISKAKGQPREPQVCTLPPSRDELTKNQVSLS CAVKGFYPSDIAVEWESNGQPENNYKTTPPVLDSDGSFFLVS KLTVDKSRWQQGNVFSCSVMHEALHNHYTQKSLSLSPGGG GGSGGGGSGGGGSGGGGSQVQLQESGPGLVRPSQTLSLTCT VSGFTISSGYSWHWVRQPPGRGLEWIGYIQYSGITNYNPSLK SRVTMLVDTSKNQFSLRLSSVTAADTAVYYCAREDYDHW YFDVWGQGSLVTVSS |
| 202 | VHCH1 (20H4.9)-Heavy chain knob-VL (431/26) | QVQLQQWGAGLLKPSETLSLTCAVYGGSFSGYYWSWIRQS PEKGLEWIGEINHGGYVTYNPSLESRVTISVDTSKNQFSLKLS SVTAADTAVYYCARDYGPGNYDWYFDLWGRGTLVTVSSA STKGPSVFPLAPSSKSTSGGTAALGCLVKDYFPEPVTVSWNS GALTSGVHTFPAVLQSSGLYSLSSVVTVPSSSLGTQTYICNV NHKPSNTKVDKKVEPKSCDKTHTCPPCPAPEAAGGPSVFLFP PKPKDTLMISRTPEVTCVVVDVSHEDPEVKFNWYVDGVEV HNAKTKPREEQYNSTYRVVSVLTVLHQDWLNGKEYKCKVS NKALGAPIEKTISKAKGQPREPQVYTLPPCRDELTKNQVSLW CLVKGFYPSDIAVEWESNGQPENNYKTTPPVLDSDGSFFLYS KLTVDKSRWQQGNVFSCSVMHEALHNHYTQKSLSLSPGGG GGSGGGGSGGGGSGGGGSDIQMTQSPSSLSASVGDRVTITCS TSSSVSYMHWYQQKPGKAPKLLIYSTSNLASGVPSRFSGSGS GTDFTFTISSLQPEDIATYYCHQWSSYPTFGQGTKVEIK |
| 46 | VLCL-Light chain (20H4.9) | see Table 1 |

The bispecific anti-4-1BB/anti-CEA antigen binding molecules were produced and purified as described for the bispecific bivalent anti-4-1BB and anti-FAP huIgG1 P329GLALA (see Example 1.1). For production in 500 mL shake flasks, 400 million HEK293 EBNA cells were seeded 24 hours before transfection. For transfection cells were centrifuged for 5 minutes by 210×g, and supernatant was replaced by pre-warmed CD CHO medium. Expression vectors were mixed in 20 mL CD CHO medium to a final amount of 200m DNA. After addition of 540 µL PEI, the solution was vortexed for 15 seconds and incubated for 10 minutes at room temperature. Afterwards, cells were mixed with the DNA/PEI solution, transferred to a 500 mL shake flask and incubated for 3 hours at 37° C. in an incubator with a 5% CO2 atmosphere. After the incubation, 160 mL F17 medium was added and cells were cultured for 24 hours. One day after transfection 1 mM valproic acid and 7% Feed were added. After culturing for 7 days, the cell supernatant was collected by centrifugation for 15 minutes at 210×g. The solution was sterile filtered (0.22 µm filter), supplemented with sodium azide to a final concentration of 0.01% (w/v), and kept at 4° C.

Secreted proteins were purified from cell culture supernatants by affinity chromatography using Protein A, followed by size exclusion chromatography. For affinity chromatography, the supernatant was loaded on a Protein A MabSelectSure column (CV=5 mL, GE Healthcare) equilibrated with 40 mL 20 mM sodium phosphate, 20 mM sodium citrate pH 7.5. Unbound protein was removed by washing with at least 10 column volumes of 20 mM sodium phosphate, 20 mM sodium citrate containing buffer (pH 7.5). The bound protein was eluted using a linear pH-gradient of sodium chloride (from 20 to 100 mM) created over 15 column volumes of 20 mM sodium citrate, 100 mM sodium chloride, 100 mM glycine, pH 3.0. The column was then washed with 10 column volumes of 20 mM sodium citrate, 100 mM NaCl, 100 mM Glycine, pH 3.0. The pH of collected fractions was adjusted by adding 1/40 (v/v) of 2M Tris, pH8.0. The protein was concentrated and filtered prior to loading on a HiLoad Superdex 16/600 S200 column (GE Healthcare) equilibrated with 20 mM histidine, 140 mM sodium chloride, pH 6.0.

The protein concentration of purified bispecific constructs was determined by measuring the OD at 280 nm, using the molar extinction coefficient calculated on the basis of the amino acid sequence. Purity and molecular weight of the bispecific constructs were analyzed by CE-SDS in the presence and absence of a reducing agent (Invitrogen, USA) using a LabChipGXII (Caliper). The aggregate content of bispecific constructs was analyzed using a TSKgel G3000 SW XL analytical size-exclusion column (Tosoh) equilibrated in a 25 mM $K_2HPO_4$, 125 mM NaCl, 200 mM L-Arginine Monohydrocloride, 0.02% (w/v) $NaN_3$, pH 6.7 running buffer at 25° C.

TABLE 32

Biochemical analysis of 2 + 1
anti-4-1BB, anti-CEA human IgG1 P329GLALA

| Molecule | Monomer [%] | Yield [mg/l] | CE-SDS (non-red) |
|---|---|---|---|
| 2 + 1 4-1BB (20H4.9)/ CEA(T84.66-LCHA) human IgG1 PGLALA, (G$_4$S)$_4$, hole-VH (Sequences see Table 23) | 95.2 | 0.1 | 81 |
| 2 + 1 4-1BB (20H4.9)/ CEA(A5B7) human IgG1 PGLALA, (G$_4$S)$_2$, hole VH (Sequences see Table 27) | 99 | 5.1 | 82 |
| 2 + 1 4-1BB (20H4.9)/ CEA(A5B7) human IgG1 PGLALA (G$_4$S)$_4$, hole-VH (Sequences see Table 25) | 95.5 | 8.4 | 97.4 |
| 2 + 1 4-1BB (20H4.9)/ CEA(A5B7P) human IgG1 PGLALA, (G$_4$S)$_4$, hole-VH (Sequences see Table 29) | 95.5 | 54 | 97.6 |

6.2 Functional In Vitro Characterization: Ability to Induce NFκB Activation Via Simultaneous Binding to 4-1BB and CEA 6.2.1 Generation of HeLa Cells Expressing Human 4-1BB and NFκB-Luciferase The cervix carcinoma cell line HeLa (ATCC CCL-2) was transduced with a plasmid, based on the expression vector pETR10829, which contains the sequence of human 4-1BB (Uniprot accession Q07011) under control of a CMV-promoter and a puromycin resistance gene. Cells were cultured in DMEM medium supplemented with 10% (v/v) FBS, 1% (v/v) GlutaMAX-I and 3 µg/mL puromycin.

4-1BB-transduced HeLa cells were tested for 4-1BB expression by flow cytometry: 0.2×106 living cells were resuspended in 100 µL FACS buffer containing 0.1 µg PerCP/Cy5.5 conjugated anti-human 4-1BB mouse IgG1κ clone 4B4-1 (BioLegend Cat. No. 309814) or its isotype control (PerCP/Cy5.5 conjugated mouse IgG1κ isotype control antibody clone MOPC 21, BioLegend Cat. No. 400150) and incubated for 30 minutes at 4° C. Cells were washed twice with FACS buffer, resuspended in 300 µL FACS buffer containing 0.06 µg DAPI (Santa Cruz Biotec, Cat. No. Sc-3598) and acquired using a 5-laser LSR-Fortessa (BD Bioscience, DIVA software). Limited dilutions were performed to generate single clones as described: human-4-1BB-transduced HeLa cells were resuspended in medium to a density of 10, 5 and 2.5 cells/ml and 200 µl of cell suspensions were transferred to round bottom tissue-culture treated 96-well plates (6 plates/cell concentration, TPP Cat. No. 92697). Single clones were harvested, expanded and tested for 4-1BB expression as described above. The clone with the highest expression of 4-1BB (clone 5) was chosen for subsequent transfection with the NFκB-luciferase expression-vector 5495p Tranlucent HygB. The vector confers transfected cells both with resistance to Hygromycin B and capacity to express luciferase under control of NFκB-response element (Panomics, Cat. No. LR0051). For transfection Human-4-1BB HeLa clone 5 cells were cultured to 70% confluence. 50 µg (40 µL) linearized (restriction enzymes AseI and SalI) 5495p Tranlucent HygB expression vector were added to a sterile 0.4 cm Gene Pulser/Micro-Pulser Cuvette (Biorad, Cat.-No, 165-2081). 2.5×106 human-4-1BB HeLa clone 5 cells in 400 µl supplement-free DMEM medium were added and mixed carefully with the plasmid solution. Transfection of cells was performed using a Gene Pulser Xcell total system (Biorad, Cat No. 165 2660) under the following settings: exponential pulse, capacitance 500 µF, voltage 160 V, resistance unlimited. Immediately after the pulse transfected cells were transferred to a 75 cm² tissue culture flask (TPP, Cat. No. 90075) with 15 mL 37° C. warm DMEM medium supplied with 10% (v/v) FBS and 1% (v/v) GlutaMAX-I. On the next day, culture medium containing 3 µg/mL Puromycin and 200m/mL Hygromycin B (Roche, Cat. No. 10843555001) was added. Surviving cells were expanded and limited dilution was performed as described above to generate single clones.

Clones were tested for 4-1BB expression as described above and for NFκB-Luciferase activity as following: Clones were harvested in selection medium and counted using a Cell Counter Vi-cell xr 2.03 (Beckman Coulter, Cat. No. 731050). Cells were set to a cell density of 0.33×106 cells/mL and 150 µL of this cell suspension were transferred to each well of a sterile white 96-well flat bottom tissue culture plate with lid (greiner bio one, Cat. No. 655083). Cells were incubated at 37° C. and 5% CO$_2$ overnight in a cell incubator (Hera Cell). The next day 50 µL of medium containing different concentrations of recombinant human tumor necrosis factor alpha (rhTNFα, PeproTech, Cat.-No. 300 01A) were added to each well of a 96-well plate resulting in final concentration of rhTNFα of 100, 50, 25, 12.5, 6.25 and 0 ng/well. Cells were incubated for 6 hours at 37° C. and 5% CO$_2$ and then washed with 200 µL/well DPBS. Reporter Lysis Buffer (Promega, Cat-No: E3971) was added to each well (40 µL) and the plates were stored over night at −20° C. The next day frozen cell plates and Detection Buffer (Luciferase 1000 Assay System, Promega, Cat. No. E4550) were thawed to room temperature. 100 µL of detection buffer were added to each well and the plate was measured as fast as possible using a SpectraMax M5/M5e microplate reader and the SoftMax Pro Software (Molecular Devices). Measured units of released light for 500 ms/well (URLs) above control (no rhTNFα added) were taken as luciferase activity. The HeLa-hu4-1BB-NFκB-luc clone 26 exhibiting the highest luciferase activity and a considerable level of 4-1BB-expression and was chosen for further use.

6.2.2 NFκB Activation in HeLa Cells Expressing Human 4-1BB Reporter Cell Lines Co-Cultured with FAP-Expressing Tumor Cells HeLa-hu4-1BB-NFκB-luc clone 26 cells were harvested and resuspended in DMEM medium supplied with 10% (v/v) FBS and 1% (v/v) GlutaMAX-I to a concentration of 0.2×10⁶ cells/mL. 100 µl (2×10⁴ cells) of this cell suspension were transferred to each well of a sterile white 96-well flat bottom tissue culture plate with lid (greiner bio one, Cat. No. 655083) and the plate were incubated at 37° C. and 5% CO$_2$ overnight. The next day 50 µL of medium containing titrated 4-1BB (20H4.9)×CEA (A5B7) 2+1 were added. CEA-expressing human gastric adenocarcinoma cell line MKN45 (DSMZ ACC 409) were resuspended in DMEM medium supplied with 10% (v/v) FBS and 1% (v/v) GlutaMAX-I to a concentration of 2×10⁶ cells/ml. Suspension of CEA-expressing MKN45 cells (50 µl) or medium as negative control was added to each well and plates were incubated for 6 hours at 37° C. and 5% CO$_2$ in the cell incubator. Cells were washed with 200 µL/well DPBS. 40 µL freshly prepared Reporter Lysis Buffer (Promega, Cat-No: E3971) were added to each well and the plates were stored over night at −20° C. The next day frozen cell plates and Detection Buffer (Luciferase 1000 Assay System, Promega, Cat. No. E4550) were thawed to room temperature. 100 µL of detection buffer were added to each well and luciferase activity was measured as fast as possible using a SpectraMax M5/M5e microplate reader and a SoftMax Pro Software (Molecular Devices).

In FIGS. 15A and 15B the activation property of 4-1BB (20H4.9)×CEA (A5B7) 2+1 ((G$_4$S)$_2$, hole VH) using a 4-1BB-expressing reporter cell line is shown. In FIG. 15A the activation property in the absence of CEA-expressing MKN45 and in FIG. 15B in the presence of MKN45 cells were tested. In the absence of any crosslinking activation is only seen at high concentrations and with a limited maximum. The EC$_{50}$ value can be decreased and the activation maximum is increased in the presence of MKN45 cells. Therefore its full potential of 4-1BB (20H4.9)×CEA (A5B7) 2+1 is only seen in the presence of CEA-mediated crosslinking. EC$_{50}$ values and area under the curve (AUC) are indicated in the graphs in FIGS. 15A and 15B.

6.3 Generation of Bispecific Antibodies with a Bivalent Binding to 4-1BB and a Monovalent Binding to CEA comprising a C-Terminally Linked Crossfab Bispecific agonistic 4-1BB antibodies with bivalent binding for 4-1BB and monovalent binding for CEA, also termed 2+1 crossfab, were prepared as depicted in FIGS. 1D and 1E. The knobs into hole technology was applied by introducing the S354C/T366W mutations in the first heavy chain HC1 (Fc knob heavy chain) and introducing the Y349C/T366S/L368A/Y407V mutations in the second heavy chain HC2 (Fc hole heavy chain) to allow generation of a heterodimer.

In this example, the HC1 of the construct was comprised of the following components: VHCH1 of the anti-4-1BB (clone 20H4.9) followed by Fc knob and a crossed VHCL, or VLCH1, of an anti-CEA clone (clone A5B7P). HC2 was comprised of VHCH1 of the anti-4-1BB (clone 20H4.9) followed by Fc hole. LC1 of the construct comprised VHCH1 of the anti-4-1BB (clone 20H4.9). LC2 of the construct comprised a crossed VLCH1, or VHCL, of an anti-CEA binder (clone A5B7P).

In one of the antigen binding molecules, to improve correct pairing of the light chains, the following mutations have been introduced in the CH-CL of the anti-4-1BB Fab: E123R and Q124K in the CL domain and K147E and K213E in the CH1 domain.

The Pro329Gly, Leu234Ala and Leu235Ala mutations were introduced in the constant region of the knob and hole heavy chains to abrogate binding to Fc gamma receptors according to the method described in International Patent Appl. Publ. No. WO2012/130831A1.

The amino acid sequences for 2+1 crossfab anti-4-1BB, anti-CEA constructs with a-CEA (A5B7P) CHCL crossfab fused to the Fc knob heavy chain can be found respectively in Table 33.

TABLE 33

Sequences of bispecific, bivalent anti-4-1BB/monovalent anti-CEA (A5B7P) human IgG1 P329GLALA antigen binding molecules (Construct with a-CEA CHCL crossfab fused to Fc knob chain, termed knob-CHCL crossfab)

| SEQ ID NO: | Description | Sequence |
|---|---|---|
| 211 | VHCH1 (20H4.9)-Heavy chain knob-VHCL (A5B7P) | QVQLQQWGAGLLKPSETLSLTCAVYGGSFSGYYWSWIRQS PEKGLEWIGEINHGGYVTYNPSLESRVTISVDTSKNQFSLKLS SVTAADTAVYYCARDYGPGNYDWYFDLWGRGTLVTVSSA STKGPSVFPLAPSSKSTSGGTAALGCLVKDYFPEPVTVSWNS GALTSGVHTFPAVLQSSGLYSLSSVVTVPSSSLGTQTYICNV NHKPSNTKVDKKVEPKSCDKTHTCPPCPAPEAAGGPSVFLFP PKPKDTLMISRTPEVTCVVVDVSHEDPEVKFNWYVDGVEV HNAKTKPREEQYNSTYRVVSVLTVLHQDWLNGKEYKCKVS NKALGAPIEKTISKAKGQPREPQVYTLPPCRDELTKNQVSLW CLVKGFYPSDIAVEWESNGQPENNYKTTPPVLDSDGSFFLYS KLTVDKSRWQQGNVFSCSVMHEALHNHYTQKSLSLSPGGG GGSGGGGSGGGGSGGGGSEVKLVESGGGLVQPGGSLRLSC ATSGFTFTDYYMNWVRQPPGKALEWLGFIGNKANGYTTEY SASVKGRFTISRDKSQSILYLQMNTLRAEDSATYYCTRDRGL RFYFDYWGQGTTLTVSSASVAAPSVFIFPPSDEQLKSGTASV VCLLNNFYPREAKVQWKVDNALQSGNSQESVTEQDSKDST YSLSSTLTLSKADYEKHKVYACEVTHQGLSSPVTKSFNRGE C |
| 212 | VHCH1 (20H4.9)-Heavy chain hole | QVQLQQWGAGLLKPSETLSLTCAVYGGSFSGYYWSWIRQS PEKGLEWIGEINHGGYVTYNPSLESRVTISVDTSKNQFSLKLS SVTAADTAVYYCARDYGPGNYDWYFDLWGRGTLVTVSSA STKGPSVFPLAPSSKSTSGGTAALGCLVEDYFPEPVTVSWNS GALTSGVHTFPAVLQSSGLYSLSSVVTVPSSSLGTQTYICNV NHKPSNTKVDEKVEPKSCDKTHTCPPCPAPEAAGGPSVFLFP PKPKDTLMISRTPEVTCVVVDVSHEDPEVKFNWYVDGVEV HNAKTKPREEQYNSTYRVVSVLTVLHQDWLNGKEYKCKVS NKALGAPIEKTISKAKGQPREPQVCTLPPSRDELTKNQVSLS CAVKGFYPSDIAVEWESNGQPENNYKTTPPVLDSDGSFFLVS KLTVDKSRWQQGNVFSCSVMHEALHNHYTQKSLSLSPGK |
| 46 | VLCL-Light chain (20H4.9) | see Table 1 |

TABLE 33 -continued

Sequences of bispecific, bivalent anti-4-1BB/monovalent anti-CEA (A5B7P) human IgG1 P329GLALA antigen binding molecules (Construct with a-CEA CHCL crossfab fused to Fc knob chain, termed knob-CHCL crossfab)

| SEQ ID NO: | Description | Sequence |
|---|---|---|
| 213 | VLCH1-Light chain (A5B7P) | QTVLSQSPAILSASPGEKVTMTCRASSSVTYIHWYQQKPGSS PKSWIYATSNLASGVPARFSGSGSGTSYSLTISRVEAEDAAT YYCQHWSSKPPTFGGGTKLEIKSSASTKGPSVFPLAPSSKSTS GGTAALGCLVKDYFPEPVTVSWNSGALTSGVHTFPAVLQSS GLYSLSSVVTVPSSSLGTQTYICNVNHKPSNTKVDKKVEPKS C |

The amino acid sequences for 2+1 crossfab anti-4-1BB, anti-CEA constructs with a-CEA (A5B7P) CHCL crossfab fused to the Fc knob heavy chain can be found respectively in Table 34.

TABLE 34

Sequences of bispecific, bivalent anti-4-1BB/monovalent anti-CEA (A5B7P) human IgG1 P329GLALA antigen binding molecules with charged variants (Constructs with a-CEA VHVL crossfab fused to Fc knob chain, termed knob-VHVL crossfab)

| SEQ ID NO: | Description | Sequence |
|---|---|---|
| 214 | VHCH1 (20H4.9)-Heavy chain knob-VLCH (A5B7P) (EE mutations) | QVQLQQWGAGLLKPSETLSLTCAVYGGSFSGYYWSWIRQS PEKGLEWIGEINHGGYVTYNPSLESRVTISVDTSKNQFSLKLS SVTAADTAVYYCARDYGPGNYDWYFDLWGRGTLVTVSSA STKGPSVFPLAPSSKSTSGGTAALGCLVEDYFPEPVTVSWNS GALTSGVHTFPAVLQSSGLYSLSSVVTVPSSSLGTQTYICNV NHKPSNTKVDEKVEPKSCDKTHTCPPCPAPEAAGGPSVFLFP PKPKDTLMISRTPEVTCVVVDVSHEDPEVKFNWYVDGVEV HNAKTKPREEQYNSTYRVVSVLTVLHQDWLNGKEYKCKVS NKALGAPIEKTISKAKGQPREPQVYTLPPCRDELTKNQVSLW CLVKGFYPSDIAVEWESNGQPENNYKTTPPVLDSDGSFFLYS KLTVDKSRWQQGNVFSCSVMHEALHNHYTQKSLSLSPGGG GGSGGGGSGGGGSGGGGSQTVLSQSPAILSASPGEKVTMTC RASSSVTYIHWYQQKPGSSPKSWIYATSNLASGVPARFSGSG SGTSYSLTISRVEAEDAATYYCQHWSSKPPTFGGGTKLEIKS SASTKGPSVFPLAPSSKSTSGGTAALGCLVKDYFPEPVTVSW NSGALTSGVHTFPAVLQSSGLYSLSSVVTVPSSSLGTQTYICN VNHKPSNTKVDKKVEPKSC |
| 215 | VHCH1 (20H4.9)-Heavy chain hole (EE mutations) | QVQLQQWGAGLLKPSETLSLTCAVYGGSFSGYYWSWIRQS PEKGLEWIGEINHGGYVTYNPSLESRVTISVDTSKNQFSLKLS SVTAADTAVYYCARDYGPGNYDWYFDLWGRGTLVTVSSA STKGPSVFPLAPSSKSTSGGTAALGCLVEDYFPEPVTVSWNS GALTSGVHTFPAVLQSSGLYSLSSVVTVPSSSLGTQTYICNV NHKPSNTKVDEKVEPKSCDKTHTCPPCPAPEAAGGPSVFLFP PKPKDTLMISRTPEVTCVVVDVSHEDPEVKFNWYVDGVEV HNAKTKPREEQYNSTYRVVSVLTVLHQDWLNGKEYKCKVS NKALGAPIEKTISKAKGQPREPQVCTLPPSRDELTKNQVSLS CAVKGFYPSDIAVEWESNGQPENNYKTTPPVLDSDGSFFLVS KLTVDKSRWQQGNVFSCSVMHEALHNHYTQKSLSLSPGK |
| 216 | VLCL-Light chain (20H4.9) (RK mutations) | EIVLTQSPATLSLSPGERATLSCRASQSVSSYLAWYQQKPGQ APRLLIYDASNRATGIPARFSGSGSGTDFTLTISSLEPEDFAVY YCQQRSNWPPALTFGGGTKVEIKRTVAAPSVFIFPPSDRKLK SGTASVVCLLNNFYPREAKVQWKVDNALQSGNSQESVTEQ DSKDSTYSLSSTLTLSKADYEKHKVYACEVTHQGLSSPVTK SFNRGEC |
| 217 | VHCL-Light chain (A5B7P) | EVKLVESGGGLVQPGGSLRLSCATSGFTFTDYYMNWVRQPP GKALEWLGFIGNKANGYTTEYSASVKGRFTISRDKSQSILYL QMNTLRAEDSATYYCTRDRGLRFYFDYWGQGTTLTVSSAS VAAPSVFIFPPSDEQLKSGTASVVCLLNNFYPREAKVQWKV DNALQSGNSQESVTEQDSKDSTYSLSSTLTLSKADYEKHKV YACEVTHQGLSSPVTKSFNRGEC |

The bispecific antibodies comprising a crossfab were generated by transient transfection of HEK293 EBNA cells. Cells were centrifuged and medium replaced by pre-warmed CD CHO medium. Expression vectors were mixed in CD CHO medium, PEI was added, the solution vortexed and incubated for 10 minutes at room temperature. Afterwards, cells were mixed with the DNA/PEI solution, transferred to shake flask and incubated for 3 hours at 37° C. in an incubator with a 5% CO$_2$ atmosphere. After the incubation, Excell medium with supplements was added. One day after transfection 12% Feed was added. Cell supernatants were harvested after 7 days and purified by standard methods.

Proteins were purified from filtered cell culture supernatants referring to standard protocols. In brief, Fc containing proteins were purified from cell culture supernatants by affinity chromatography using Protein A. Elution was achieved at pH 3.0 followed by immediate neutralization of the sample. The protein was concentrated and aggregated protein was separated from monomeric protein by size exclusion chromatography in 20 mM histidine, 140 mM sodium chloride, pH 6.0.

The protein concentration of purified constructs was determined by measuring the optical density (OD) at 280 nm, using the molar extinction coefficient calculated on the basis of the amino acid sequence according to Pace, et al., Protein Science, 1995, 4, 2411-1423. Purity and molecular weight of the proteins were analyzed by CE-SDS in the presence and absence of a reducing agent using a LabChipGXII. Determination of the aggregate content was performed by HPLC chromatography using analytical size-exclusion column (TSKgel G3000 SW XL) equilibrated in a 25 mM $K_2HPO_4$, 125 mM NaCl, 200 mM L-Arginine Monohydrocloride, pH 6.7 running buffer at 25° C.

TABLE 35

Biochemical analysis of 2 + 1 anti-4-1BB, anti-CEA crosstab human IgG1 PGLALA antigen binding molecules

| Molecule | Monomer [%] | Yield [mg/l] | CE-SDS (non-red) |
|---|---|---|---|
| 2 + 1 4-1BB (20H4.9)/ CEA(A5B7P) human IgG1 PGLALA, CEA with CHCL crossfab (Sequences see Table 33) | 99.2 | 6.1 | 95 |
| 2 + 1 4-1BB (20H4.9)/ CEA(A5B7P) human IgG1 PGLALA, CEA with VHVL crossfab (Sequences see Table 34) | 99.5 | 2.1 | 98.3 |

6.3.1 Functional Characterization of 2+1 Bispecific 4-1BB Antibodies Comprising a C-Terminally Linked CEA Crossfab The capacity of binding simultaneously human 4-1BB Fc(kih) and human CEA, using the antigen N(A2-B2)A which refers to a specific epitope region on CEA, was assessed by surface plasmon resonance (SPR). All SPR experiments were performed on a Biacore T200 at 25° C. with HBS-EP as running buffer (0.01 M HEPES pH 7.4, 0.15 M NaCl, 3 mM EDTA, 0.005% Surfactant P20, Biacore, Freiburg/Germany). Human N(A2-B2)A was directly coupled to a flow cell by amine coupling (CM5 sensor chip). Immobilization levels of 750 resonance units (RU) were used.

The CEA-targeted 4-1BB antibody was passed at a concentration range of 200 nM with a flow of 30 µL/minute through the flow cells over 90 seconds and dissociation was set to zero sec. Human 4-1BB Fc(kih) was injected as second analyte with a flow of 30 µL/minute through the flow cells over 90 seconds at a concentration of 500 nM (FIG. 20A). The dissociation was monitored for 120 sec. Bulk refractive index differences were corrected for by subtracting the response obtained in a reference flow cell, where no protein was immobilized.

As can be seen in the graphs of FIGS. 20B and 20C, the 2+1 bispecific agonistic 4-1BB antibodies with monovalent binding for CEA can bind simultaneously human N(A2-B2)A and human 4-1BB.

6.4. Binding on Cells 6.4.1. Binding on Human 4-1BB Expressing Cell Line Jurkat-Hu4-1BB-NFκB-Luc2

To determine binding to cell-expressed 4-1BB, Jurkat-hu4-1BB-NFκB-luc2 (Promega, CS196004) cells were used. Therefore $0.2 \times 10^6$ Jurkat-hu4-1BB-NFκB-luc cells were added to each well of a round-bottom suspension cell 96-well plates (Greiner bio-one, cellstar, Cat.-No. 650185). Plates were centrifuged 4 minutes with 400×g at 4° C. and supernatant was discarded. Cells were washed with 200 µL/well DPBS and then incubated for 30 min at 4° C. with 100 µL/mL DPBS containing 1:5000 diluted Fixable Viability Dye eFluor 450 (eBioscience, Cat.-No. 65-0863-18). Afterwards cells were washed once with 200 µL/well cold DPBS. Next, 50 µL/well of 4° C. cold FACS buffer containing titrated bispecific CEA-targeted anti-human 4-1BB molecules were added and cells were incubated for 60 minutes at 4° C. Cells were washed four times with 200 µL/well 4° C. cold FACS buffer to remove unbound molecules. Afterwards cells were further incubated with 50 µL/well of 4° C. cold FACS buffer containing 2.5 µg/mL PE-conjugated AffiniPure anti-human IgG Fcγ-fragment-specific goat F(ab')$_2$ fragment (Jackson ImmunoResearch, Cat.-No. 109-116-098) and incubated for 30 minutes at 4° C. Cells were washed twice with 200 µL FACS buffer/well and fixated by resuspending in 50 µL/well DPBS containing 1% Formaldehyde (Sigma, HT501320-9.5L). Cells were acquired the same or next day using 3-laser MACSQuant Analyzer 10 (Miltenyi Biotech). Gates were set on living cells the geo mean of fluorescence intensity (MFI) of the secondary detection antibody was used to analyze binding of primary antibodies. Using Graph Pad Prism (Graph Pad Software Inc.) data was baselined by subtracting the blank values (no primary antibody added), the EC50 values were calculated using non-linear regression curve fit (robust fit) as well as the area under the curve (AUC).

In FIG. 21A the binding to Jurkat-hu4-1BB-NFκB-luc2 is shown for bispecific CEA-targeted 4-1BB agonistic molecules. All molecules are containing a bivalent 4-1BB-antigen binding clone 20H4.9 moiety and show similar binding to the human 4-1BB expressing cells independently of their CEA-binding moiety (differ in clone or fusion). Only 4-1BB (20H4.9)×CEA (A5B7) 2+1 (black triangle) showed a little bit lower $EC_{50}$ value (Table 36) and a slightly increased AUC (FIG. 21C). An included negative control e.g. untargeted DP47 huIgG1 P329G LALA (open black circle) displayed the baseline. In Table 36 the EC50 values are listed.

TABLE 36

$EC_{50}$ values of binding curves to human 4-1BB-expressing transgenic cell line Jurkat-hu4-1BB-NFκB-luc2

| | $EC_{50}$ [nM] on Jurkat-hu4-1BB-NFκB-1uc2 |
|---|---|
| 4-1BB (20H4.9) × DP47 2 + 1 | 0.05 |
| 4-1BB (20H4.9) × CEA(A5B7) 2 + 1 | 0.01 |
| 4-1BB (20H4.9) × CEA (A5B7P) 2 + 1 | 0.06 |
| 4-1BB (20H4.9) × CEA (A5B7P) 2 + 1 CHCL crossfab | 0.06 |
| 4-1BB (20H4.9) × CEA (A5B7P) 2 + 1 VHVL crossfab | 0.05 |
| 4-1BB (20H4.9) × CEA (T84.66-LCHA) 2 + 1 | 0.07 |

6.4.2. Binding to Human CEA-Expressing Tumor Cell Line

To determine binding to cell-expressed CEA, human gastric cancer cell line MKN45 (DSMZ ACC 409) was used. Therefore $0.2 \times 10^6$ MKN45 cells were added to each well of a round-bottom suspension cell 96-well plates (Greiner bio-one, cellstar, Cat.-No. 650185). Plates were centrifuged 4 minutes with 400×g at 4° C. and supernatant was discarded. Cells were washed with 200 µL/well DPBS and then incubated for 30 min at 4° C. with 100 µL/mL DPBS containing 1:5000 diluted Fixable Viability Dye eFluor 450 (eBioscience, Cat.-No. 65-0863-18). Afterwards cells were washed once with 200 µL/well cold DPBS. Next, 50 µL/well of 4° C. cold FACS buffer containing titrated bispecific CEA-targeted anti-human 4-1BB molecules were added and cells were incubated for 60 minutes at 4° C. Cells were washed four times with 200 µL/well 4° C. FACS buffer to remove unbound molecules. Afterwards cells were further incubated with 50 µL/well of 4° C. cold FACS buffer containing 2.5 µg/mL PE-conjugated AffiniPure anti-human IgG Fcγ-fragment-specific goat F(ab')2 fragment (Jackson ImmunoResearch, Cat.-No. 109-116-098) and incubated for 30 minutes at 4° C. Cells were washed twice with 200 µL FACS buffer/well and fixated by resuspending in 50 µL/well DPBS containing 1% Formaldehyde (Sigma, HT501320-9.5L). Cells were acquired the same or next day using 3-laser MACSQuant Analyzer 10 (Miltenyi Biotech). Gates were set on living cells the geo mean of fluorescence intensity (MFI) of the secondary detection antibody was used to analyze binding of primary antibodies. Using Graph Pad Prism (Graph Pad Software Inc.) data was baselined by subtracting the blank values (no primary antibody added), the $EC_{50}$ values were calculated using non-linear regression curve fit (robust fit) as well as the area under the curve (AUC).

In FIG. 21B the binding to CEA-expressing human gastric cancer cell line MKN45 is shown for bispecific CEA-targeted 4-1BB agonistic molecules. The strongest affinity was seen with molecule 4-1BB (20H4.9)×CEA (A5B7) 2+1 (black triangle) displayed by the lowest $EC_{50}$ value of 8.9 nM and the highest AUC value shown in FIG. 21D. All other binding curves did not reach the plateau at the tested concentrations and therefore no further $EC_{50}$ are indicated. Depending on the format and CEA-binding clone integrated in the molecules, bispecific CEA-targeted 4-1BB agonistic molecules display different affinities to CEA-expressing MKN45 cells as also displayed in the AUC in FIG. 21D.

6.5 NFκB Activation

6.5.1 NFκB Activation in HeLa or Jurkat Expressing Human 4-1BB and Luciferase Reporter Cell Line Co-Cultured with CEA-Expressing Tumor Cells Either HeLa-hu4-1BB-NFκB-luc clone 26 (like in FIG. 15, generation described under 2.5.1.) or Jurkat-hu4-1BB-NFκB-luc2 (purchased from Promega, CS196004) were used as reporter cell line. HeLa-hu4-1BB-NFκB-luc clone 26 cells were harvested and resuspended in DMEM medium supplied with 10% (v/v) FBS and 1% (v/v) GlutaMAX-I to a concentration of $0.2 \times 10^6$ cells/mL. In case Jurkat-hu4-1BB-NFκB-luc2 cells were used as reporter cell line, cells were harvested and resuspended in RPMI 1640 medium supplied with 10% (v/v) FBS and 1% (v/v) GlutaMAX-I to a concentration of $0.2 \times 10^6$ cells/mL. 100 µl ($2 \times 10^4$ cells) of this cell suspension were transferred to each well of a sterile white 96-well flat bottom tissue culture plate with lid (greiner bio one, Cat. No. 655083). In case of HeLa-hu4-1BB-NFκB-luc clone 26 cells plates were incubated at 37° C. and 5% $CO_2$ overnight. To perform the assay 50 µL of medium containing titrated bispecific CEA-targeted anti-human 4-1BB molecules were added. CEA-expressing human gastric adenocarcinoma cell line MKN45 (DSMZ ACC 409) were resuspended in DMEM medium (if HeLa-hu4-1BB-NFκB-luc clone 26 were used as reporter cell line) or RPMI 1640 medium (if Jurkat-hu4-1BB-NFκB-luc2 were used as reporter cell line) supplied with 10% (v/v) FBS and 1% (v/v) GlutaMAX-I to a concentration of $2 \times 10^6$ cells/ml. Suspension of CEA-expressing MKN45 cells (50 µl) or medium as negative control was added to each well and plates were incubated for 6 hours at 37° C. and 5% $CO_2$ in the cell incubator. Cells were washed with 200 µL/well DPBS. 40 µL freshly prepared Reporter Lysis Buffer (Promega, Cat-No: E3971) were added to each well and the plates were stored over night at −20° C. The next day frozen cell plates and Detection Buffer (Luciferase 1000 Assay System, Promega, Cat. No. E4550) were thawed at room temperature. 100 µL of detection buffer were added to each well and luciferase activity was measured as fast as possible using a SpectraMax M5/M5e microplate reader and a SoftMax Pro Software (Molecular Devices).

Figure 23A:
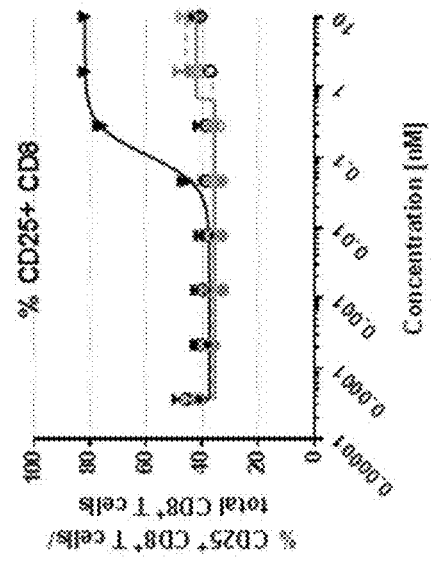
Figure 23B:
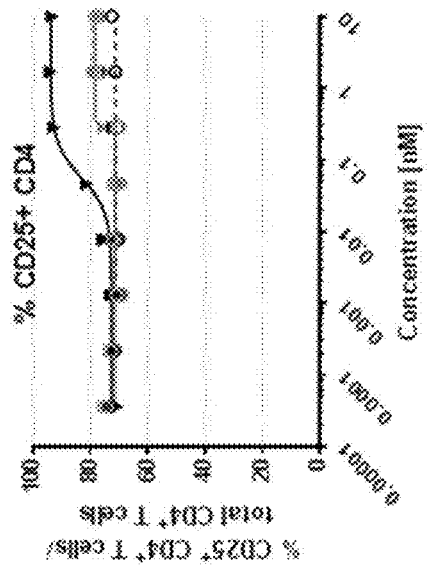
Figure 23C:
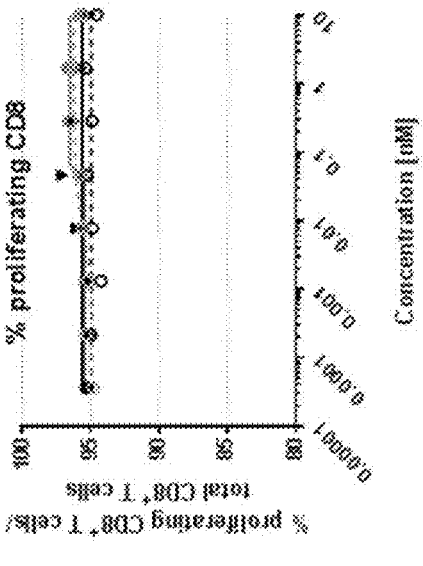
Figure 23D:
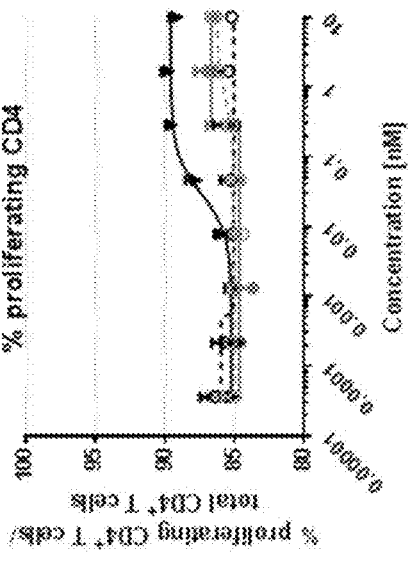

In FIGS. 23A and 23B the activation properties of different CEA-targeted 4-1BB (20H4.9) molecules are shown using the 4-1BB-expressing reporter cell line Jurkat-hu4-1BB-NFκB-luc2. In FIG. 23A the activation property in the absence of CEA-expressing MKN45 and in FIG. 23B in the presence of MKN45 cells were tested. In the absence of any crosslinking activation is only seen at high concentrations and with a limited maximum. The $EC_{50}$ values are decreased and the activation maximum are increased in the presence of MKN45 cells in the presence of CEA-targeted 4-1BB (20H4.9) molecules. AUC values are displayed in FIG. 23C. Activation property correlates positively with binding affinity to CEA-expressing MKN45 cells shown in FIG. 21B. $EC_{50}$ values are listed in Table 37.

TABLE 37

$EC_{50}$ values of Jurkat-hu4-1BB-NFκB-luc2 reporter cell line activation curves in the presence of CEA-expressing MKN45 tumor cells.

| | $EC_{50}$ [nM] |
|---|---|
| 4-1BB (20H4.9) × CEA(A5B7P) 2 + 1 CHCL crossfab | 0.09 |
| 4-1BB (20H4.9) × CEA(A5B7P) 2 + 1 VHVL crossfab | 0.05 |
| 4-1BB (20H4.9) × CEA(A5B7P) 2 + 1 | 0.16 |
| 4-1BB (20H4.9) × CEA(T84.66-LCHA) 2 + 1 | 0.19 |
| 4-1BB (20H4.9) × CEA(A5B7) 2 + 1 | 0.03 |
| 4-1BB (20H4.9) × DP47 2 + 1 | 0.09 |
| 4-1BB (20H4.9) huIgG1 P329G LALA | 0.02 |

6.6 Activation Assay of Human PBMCs in the Presence of CEA-Expressing Tumor Cells CEA-expressing human gastric cancer cell line MKN45 was washed with DPBS (Gibco by Life Technologies, Cat. No. 14190 326) and treated with enzyme-free, PBS-based Cell Dissociation Buffer (Gibco by Life Technologies, Cat.-No. 13151-014) for 10 minutes at 37° C. Cells were harvested and resuspended in T cell medium consisting of RPMI 1640 (GIBCO by Life Technologies, Cat.-No. 42401-042) supplied with 10% fetal bovine serum (FBS, US-origin, PAN biotech, P30-2009, Lot P150307GI, gamma irradiated *mycoplasma* free, heat inactivated 35 min 56° C.), 1% L-GlutaMAX-I (GIBCO by Life Technologies, Cat-No. 35050-038), 1 mM Sodium-Pyruvat (SIGMA-Aldrich, Cat.-No. S8636), 1% MEM-non essential amino acid Solution (SIGMA-Aldrich, Cat.-No. M7145), 50 uM β-Mercaptoethanol (Sigma-Aldrich, Cyt.-No. M3148) and irradiated with 50 Gy (X-Ray Irradiator RS 2000, Rad source). $2 \times 10^4$ MKN45 cells in 50 µL T cell medium were seeded to each well of a round bottom tissue culture 96-well plate (TTP, Cat.-No. 92697). 50 µL of T cell medium containing different titrated concentrations of CEA-targeted 4-1BB agonistic molecules or controls were added respectively. Human PBMCs were labeled in 37° C. warm DPBS containing 40 nM CFDA-SE (SIGMA-Aldrich, Cat.-No. 21888-25MG-F) for 15 min at 37° C. CFSE-labeling was stopped by adding FBS, PBMCs were washed twice and resuspended in T cell medium to a final concentration of $1.5 \times 10^6$ cells/mL. 50 µL of this PBMC cell solution were seeded to each well to add $7.5 \times 10^4$ CFSE-labeled PBMCs well. Finally a stock solution of T cell medium containing 2 mM agonistic anti-human CD3 human IgG1 clone V9 was prepared and 50 µL/well were added to each well giving a final concentration of 0.5 mM anti-human CD3 human IgG1 clone V9.

Plates were incubated for 4 days at 37° C. Cells were washed with DPBS and stained with 100 µL/well DPBS containing 1:1000 diluted LIVE/DEAD Fixable Aqua Dead Cell Stain Kit (Molecular Probes by Life Technology, Cat.-No. L34957) for 30 min at 4° C. Cells were washed once with 200 µL/well DPBS and stained with 50 µL FACS buffer (DPBS supplied with 2% FBS, 5 mM EDTA pH8 (Amresco, Cat. No. E177) and 7.5 mM Sodium azide (Sigma-Aldrich S2002)) containing 0.1 µg/mL PerCP-Cy5.5-conjugated anti-human CD137 mouse IgG1 κ (clone 4B4-1, BioLegend, Cat.-No. 309814), 0.1 µg/mL PE/Cy7-conjugated anti-human PD-1 mouse IgG1 κ (clone EH12.2H7, BioLegend, Cat.-No. 329918), 0.03 µg/mL APC-conjugated anti-human CD25 mouse IgG1 κ (clone BC96, BioLegend, Cat.-No. 302610), 0.06 µg/mL APC/Cy7-conjugated anti-human CD8 Mouse IgG1 κ (clone RPA-T8, BioLegend, Cat.-No. 3301016), BV421-conjugated anti-human CD4 Mouse IgG1 κ (clone RPA-T4, BioLegend, Cat.-No. 300532) for 30 min at 4° C. Plates were washed twice with 200 µL/well DPBS and cells were fixed for 15 min with DPBS containing 1% Formaldehyde (Sigma, HT501320-9.5L). Cells were resuspended in 100 µL/well FACS-buffer and acquired using the MACS Quant Analyzer 10 (Miltenyi Biotech). Data was analyzed using FlowJo V10 (FlowJo, LLC) and GraphPad Prism 6.04 (GraphPad Software, Inc).

As shown in FIGS. 23A to 23D, the 4-1BB (20H4.9)×CEA (A5B7) 2+1 (G4S)2 molecule was able to induce upregulation of CD25 as well as improved proliferation of CD4 and CD8 T cells in the presence of a suboptimal CD3 stimulus. Untargeted 4-1BB (20H4.9)×DP47 2+1 or 4-1BB (20H4.9) huIgG1 P329G LALA molecules only induced limited T cell activation. Therefore, in the presence of CEA-expressing cells and a suboptimal TCR-stimulus 4-1BB (20H4.9)×CEA (A5B7) 2+1 (G4S)2 agonist can induce stronger T cell activation and proliferation than non-targeted molecules. In Table 38 $EC_{50}$ values are listed.

TABLE 38

$EC_{50}$ values of PBMC activation curves in the presence of CEA-expressing MKN45 tumor cells.

|  | 4-1BB (20H4.9) × CEA (A5B7) 2 + 1 (G4S)2 | 4-1BB (20H4.9) × DP47 2 + 1 | 4-1BB (20H4.9) huIgG1 P329G LALA |
|---|---|---|---|
| EC50 % CD25+ CD4 | 0.06 | 1.63 | 0.29 |
| EC50 % CD25+ CD8 | 0.11 | 1.70 | 0.67 |
| EC50 % Proliferating CD4 | 0.03 | 0.73 | 0.28 |

As shown in FIGS. 24A to 24D, activation of PBMCs from another donor as shown in FIG. 23 was monitored. All CEA-targeted 4-1BB (20H4.9) agonistic molecules were able to induce upregulation of CD25 as well as improved proliferation of CD4 and CD8 T cells in the presence of a suboptimal CD3 stimulus above untargeted 4-1BB (20H4.9) molecules. In Table 39 $EC_{50}$ values are listed.

TABLE 39

$EC_{50}$ values of PBMC activation curves in the presence of CEA-expressing MKN45 tumor cells.

|  | 4-1BB (20H4.9) × DP47 2 + 1 | 4-1BB (20H4.9) huIgG1 P329G LALA | 4-1BB (20H4.9) × CEA(A5B7P) 2 + 1 | 4-1BB (20H4.9) × CEA (A5B7P) 2 + 1 CHCL cross | 4-1BB (20H4.9) × CEA (A5B7P) 2 + 1 VHVL cross |
|---|---|---|---|---|---|
| EC50 % CD25+ CD4 | 1.64 | 0.61 | 0.24 | 0.19 | 0.14 |
| EC50 % CD25+ CD8 | 1.80 | 1.48 | 0.70 | 0.24 | 0.29 |
| EC50 % Proliferating CD4 | 1.10 | 0.09 | 0.13 | 0.23 | 0.14 |
| EC50 % Proliferating CD8 | 1.10 | 0.06 | 0.09 | 0.20 | 0.15 |

Example 7

Preparation, Purification and Characterization of Bispecific Antibodies with a Tetravalent Binding to 4-1BB and a Monovalent Binding to CEA 7.1 Generation of Bispecific Antibodies with a Tetravalent Binding to 4-1BB and a Monovalent Binding to CEA Bispecific agonistic 4-1BB antibodies with tetravalent binding for 4-1BB and monovalent binding for CEA, also termed 4+1, were prepared as depicted in FIGS. 4A and 4B. The knobs into hole technology was applied by introducing the S354C/T366W mutations in the first heavy chain HC1 (Fc knob heavy chain) and introducing the Y349C/T366S/L368A/Y407V mutations in the second heavy chain HC2 (Fc hole heavy chain) to allow generation of a heterodimer.

In this example, the first heavy chain HC1 of the construct was comprised of the following components: VHCH1_VHCH1 of anti-4-1BB binder (clone 20H4.9), followed by Fc hole, at which C-terminus a VL or VH of anti-CEA binder (clone T84.66-LCHA or A5B7) was fused. The second heavy chain HC2 was comprised of VHCH1_VHCH1 of anti-4-1BB binder (clone 20H4.9), followed by Fc knob, at which C-terminus a VH or VL, respectively, of anti-FAP binder (clone T84.66-LCHA or A5B7) was fused. The generation and preparation of CEA binder T84.66-LCHA is described in WO 2016/075278 A2, which is incorporated herein by reference. The VH and VL sequences of CEA clone A5B7 were obtained from WO 2007/071426 and are derived from murine anti-CEA clone A5B7. For the 4-1BB binder, the VH and VL sequences of clone 20H4.9 were obtained in accordance with U.S. Pat. No. 7,288,638 B2 or U.S. Pat. No. 7,659,384 B2. Combination of the two heavy chains allows generation of a heterodimer, which includes a CEA binding moiety and four 4-1BB binding Fabs.

The Pro329Gly, Leu234Ala and Leu235Ala mutations have been introduced in the constant region of the knob and hole heavy chains to abrogate binding to Fc gamma receptors according to the method described in International Patent Appl. Publ. No. WO2012/130831A1.

The bispecific 4+1 anti-4-1BB anti-FAP huIgG1 P329GLALA antigen binding molecules were produced by co-transfecting HEK293-EBNA cells with the mammalian expression vectors using polyethylenimine. The cells were transfected with the corresponding expression vectors in a 1:1:1 ratio ("vector knob heavy chain": "vector light chain": "vector hole heavy chain").

The antigen binding molecule was produced and purified as described for the bispecific bivalent anti-4-1BB and anti-FAP huIgG1 P329GLALA (see Example 1.1).

The base pair and amino acid sequences for 4+1 anti-4-1BB, anti-CEA (T84.66-LCHA) constructs with a-CEA VH fused to the Fc knob heavy chain and VL fused to Fc hole heavy chain can be found respectively in Table 40. The base pair and amino acid sequences for 4+1 anti-4-1BB, anti-CEA (T84.66-LCHA) constructs with a-CEA VL fused to Fc knob heavy chain and VH fused to Fc hole heavy chain can be found respectively in Table 41.

TABLE 40

Sequences of bispecific, tetravalent anti-4-1BB/monovalent anti-CEA (T84.66-LCHA) human IgG1 P329GLALA antigen binding molecules (Constructs with a-CEA VL fused to Fc hole chain and VH fused to Fc knob chain, termed hole-VL)

| SEQ ID NO: | Description | Sequence |
|---|---|---|
| 79 | VHCH1-VHCH1 (20H4.9)-Heavy chain hole-VL(T84.66-LCHA) (nucleotide sequence) | CAGGTGCAGCTGCAGCAGTGGGGAGCCGGCCTGCTGAAG<br>CCCAGCGAGACACTGAGCCTGACCTGCGCCGTGTACGGC<br>GGCAGCTTCAGCGGCTACTACTGGTCCTGGATCCGGCAGA<br>GCCCCGAGAAGGGCCTGGAATGGATCGGCGAGATCAACC<br>ACGGCGGCTACGTGACCTACAACCCCAGCCTGGAAAGCA<br>GAGTGACCATCAGCGTGGACACCAGCAAGAACCAGTTCA<br>GCCTGAAGCTGAGCAGCGTGACAGCCGCCGACACCGCCG<br>TGTACTACTGCGCCAGAGACTACGGCCCTGGCAACTACG<br>ACTGGTACTTCGACCTGTGGGGCAGAGGCACCCTGGTGA<br>CAGTGTCCAGCGCTTCTACCAAGGGCCCCAGCGTGTTCC<br>TCTGGCCCCTAGCAGCAAGAGCACATCTGGCGGAACAGC<br>CGCCCTGGGCTGCCTCGTGAAGGACTACTTTCCCGAGCCC<br>GTGACAGTGTCCTGGAACTCTGGCGCCCTGACAAGCGGC<br>GTGCACACCTTTCCAGCCGTGCTGCAGAGCAGCGGCCTGT<br>ACTCTCTGAGCAGCGTCGTGACTGTGCCCAGCAGCAGCCT<br>GGGAACCCAGACCTACATCTGCAACGTGAACCACAAGCC<br>CAGCAACACCAAGGTGGACAAGAAGGTGGAACCCAAGA<br>GCTGCGACGGCGGAGGCGGATCTGGCGGCGGAGGATCCC<br>AGGTGCAGCTGCAGCAGTGGGGAGCCGGCCTGCTGAAGC<br>CCAGCGAGACACTGAGCCTGACCTGCGCCGTGTACGGCG<br>GCAGCTTCAGCGGCTACTACTGGTCCTGGATCCGGCAGAG<br>CCCCGAGAAGGGCCTGGAATGGATCGGCGAGATCAACCA<br>CGGCGGCTACGTGACCTACAACCCCAGCCTGGAAAGCAG<br>AGTGACCATCAGCGTGGACACCAGCAAGAACCAGTTCAG<br>CCTGAAGCTGAGCAGCGTGACAGCCGCCGACACCGCCGT<br>GTACTACTGCGCCAGAGACTACGGCCCTGGCAACTACGA<br>CTGGTACTTCGACCTGTGGGGCAGAGGCACCCTGGTGAC<br>AGTGTCCAGCGCTAGCACCAAGGGCCCATCGGTCTTCCCC<br>CTGGCACCCTCCTCCAAGAGCACCTCTGGGGGCACAGCG<br>GCCCTGGGCTGCCTGGTCAAGGACTACTTCCCCGAACCGG<br>TGACGGTGTCGTGGAACTCAGGCGCCCTGACCAGCGGCG<br>TGCACACCTTCCCGGCTGTCCTACAGTCCTCAGGACTCTA<br>CTCCCTCAGCAGCGTGGTGACCGTGCCCTCCAGCAGCTTG<br>GGCACCCAGACCTACATCTGCAACGTGAATCACAAGCCC<br>AGCAACACCAAGGTGGACAAGAAAGTTGAGCCCAAATCT<br>TGTGACAAAACTCACACATGCCCACCGTGCCCAGCACCTG<br>AAGCTGCAGGGGGACCGTCAGTCTTCCTCTTCCCCCCAAA<br>ACCCAAGGACACCCTCATGATCTCCCGGACCCCTGAGGTC<br>ACATGCGTGGTGGTGGACGTGAGCCACGAAGACCCTGAG<br>GTCAAGTTCAACTGGTACGTGGACGGCGTGGAGGTGCAT<br>AATGCCAAGACAAAGCCGCGGGAGGAGCAGTACAACAG<br>CACGTACCGTGTGGTCAGCGTCCTCACCGTCCTGCACCAG<br>GACTGGCTGAATGGCAAGGAGTACAAGTGCAAGGTCTCC<br>AACAAAGCCCTCGGCGCCCCCATCGAGAAAACCATCTCC<br>AAAGCCAAAGGGCAGCCCCGAGAACCACAGGTGTGCACC |

TABLE 40 -continued

Sequences of bispecific, tetravalent anti-4-1BB/monovalent anti-CEA (T84.66-LCHA) human IgG1 P329GLALA antigen binding molecules (Constructs with a-CEA VL fused to Fc hole chain and VH fused to Fc knob chain, termed hole-VL)

| SEQ ID NO: | Description | Sequence |
|---|---|---|
|  |  | CTGCCCCCATCCCGGGATGAGCTGACCAAGAACCAGGTC<br>AGCCTCTCGTGCGCAGTCAAAGGCTTCTATCCCAGCGACA<br>TCGCCGTGGAGTGGGAGAGCAATGGGCAGCCGGAGAACA<br>ACTACAAGACCACGCCTCCCGTGCTGGACTCCGACGGCTC<br>CTTCTTCCTCGTGAGCAAGCTCACCGTGGACAAGAGCAGG<br>TGGCAGCAGGGGAACGTCTTCTCATGCTCCGTGATGCATG<br>AGGCTCTGCACAACCACTACACGCAGAAGAGCCTCTCCCT<br>GTCTCCGGGTGGAGGCGGCGGAAGCGGAGGAGGAGGATC<br>CGGCGGCGGAGGTTCCGGAGGCGGAGGATCCGAGATCGT<br>GCTGACCCAGAGCCCTGCCACCCTGTCACTGTCTCCAGGC<br>GAGAGAGCCACCCTGAGCTGTAGAGCCGGCGAGAGCGTG<br>GACATCTTCGGCGTGGGATTTCTGCACTGGTATCAGCAGA<br>AGCCCGGCCAGGCCCCCAGACTGCTGATCTACAGAGCCA<br>GCAACCGGGCCACAGGCATCCCCGCCAGATTTTCTGGCTC<br>TGGCAGCGGCACCGACTTCACCCTGACAATCAGCAGCCT<br>GGAACCCGAGGACTTCGCCGTGTACTACTGCCAGCAGAC<br>CAACGAGGACCCCTACACCTTTGGCCAGGGCACCAAGCT<br>GGAAATCAAG |
| 80 | VHCH1-VHCH1 (20H4.9)-Heavy chain knob-VH(T84.66-LCHA) (nucleotide sequence) | CAGGTGCAGCTGCAGCAGTGGGGAGCCGGCCTGCTGAAG<br>CCCAGCGAGACACTGAGCCTGACCTGCGCCGTGTACGGC<br>GGCAGCTTCAGCGGCTACTACTGGTCCTGGATCCGGCAGA<br>GCCCCGAGAAGGGCCTGGAATGGATCGGCGAGATCAACC<br>ACGGCGGCTACGTGACCTACAACCCCAGCCTGGAAAGCA<br>GAGTGACCATCAGCGTGGACACCAGCAAGAACCAGTTCA<br>GCCTGAAGCTGAGCAGCGTGACAGCCGCCGACACCGCCG<br>TGTACTACTGCGCCAGAGACTACGGCCCTGGCAACTACG<br>ACTGGTACTTCGACCTGTGGGGCAGAGGCACCCTGGTGA<br>CAGTGTCCAGCGCTTCTACCAAGGGCCCCAGCGTGTTCCC<br>TCTGGCCCCTAGCAGCAAGAGCACATCTGGCGGAACAGC<br>CGCCCTGGGCTGCCTCGTGAAGGACTACTTTCCCGAGCCC<br>GTGACAGTGTCCTGGAACTCTGGCGCCCTGACAAGCGGC<br>GTGCACACCTTTCCAGCCGTGCTGCAGAGCAGCGGCCTGT<br>ACTCTCTGAGCAGCGTCGTGACTGTGCCCAGCAGCAGCCT<br>GGGAACCCAGACCTACATCTGCAACGTGAACCACAAGCC<br>CAGCAACACCAAGGTGGACAAGAAGGTGGAACCCAAGA<br>GCTGCGACGGCGGAGGCGGATCTGGCGGCGGAGGATCCC<br>AGGTGCAGCTGCAGCAGTGGGGAGCCGGCCTGCTGAAGC<br>CCAGCGAGACACTGAGCCTGACCTGCGCCGTGTACGGCG<br>GCAGCTTCAGCGGCTACTACTGGTCCTGGATCCGGCAGAG<br>CCCCGAGAAGGGCCTGGAATGGATCGGCGAGATCAACCA<br>CGGCGGCTACGTGACCTACAACCCCAGCCTGGAAAGCAG<br>AGTGACCATCAGCGTGGACACCAGCAAGAACCAGTTCAG<br>CCTGAAGCTGAGCAGCGTGACAGCCGCCGACACCGCCGT<br>GTACTACTGCGCCAGAGACTACGGCCCTGGCAACTACGA<br>CTGGTACTTCGACCTGTGGGGCAGAGGCACCCTGGTGAC<br>AGTGTCCAGCGCTAGCACCAAGGGCCCATCGGTCTTCCCC<br>CTGGCACCCTCCTCCAAGAGCACCTCTGGGGGCACAGCG<br>GCCCTGGGCTGCCTGGTCAAGGACTACTTCCCCGAACCGG<br>TGACGGTGTCGTGGAACTCAGGCGCCCTGACCAGCGGCG<br>TGCACACCTTCCCGGCTGTCCTACAGTCCTCAGGACTCTA<br>CTCCCTCAGCAGCGTGGTGACCGTGCCCTCCAGCAGCTTG<br>GGCACCCAGACCTACATCTGCAACGTGAATCACAAGCCC<br>AGCAACACCAAGGTGGACAAGAAAGTTGAGCCCAAATCT<br>TGTGACAAAACTCACACATGCCCACCGTGCCCAGCACCTG<br>AAGCTGCAGGGGGACCGTCAGTCTTCCTCTTCCCCCCAAA<br>ACCCAAGGACACCCTCATGATCTCCCGGACCCCTGAGGTC<br>ACATGCGTGGTGGTGGACGTGAGCCACGAAGACCCTGAG<br>GTCAAGTTCAACTGGTACGTGGACGGCGTGGAGGTGCAT<br>AATGCCAAGACAAAGCCGCGGGAGGAGCAGTACAACAG<br>CACGTACCGTGTGGTCAGCGTCCTCACCGTCCTGCACCAG<br>GACTGGCTGAATGGCAAGGAGTACAAGTGCAAGGTCTCC<br>AACAAAGCCCTCGGCGCCCCCATCGAGAAAACCATCTCC<br>AAAGCCAAAGGGCAGCCCCGAGAACCACAGGTGTACACC<br>CTGCCCCCCTGCAGAGATGAGCTGACCAAGAACCAGGTG<br>TCCCTGTGGTGTCTGGTCAAGGGCTTCTACCCCAGCGATA<br>TCGCCGTGGAGTGGGAGAGCAACGGCCAGCCTGAGAACA<br>ACTACAAGACCACCCCCCCTGTGCTGGACAGCGACGGCA<br>GCTTCTTCCTGTACTCCAAACTGACCGTGGACAAGAGCCG<br>GTGGCAGCAGGGCAACGTGTTCAGCTGCAGCGTGATGCA<br>CGAGGCCCTGCACAACCACTACACCCAGAAGTCCCTGAG<br>CCTGAGCCCCGCGAGGCGGCGGAAGCGGAGGAGGAG<br>GATCTGGGGCGGAGGTTCCGGAGGCGGTGGATCTCAGG |

TABLE 40 -continued

Sequences of bispecific, tetravalent anti-4-1BB/monovalent anti-CEA (T84.66-LCHA) human IgG1 P329GLALA antigen binding molecules (Constructs with a-CEA VL fused to Fc hole chain and VH fused to Fc knob chain, termed hole-VL)

| SEQ ID NO: | Description | Sequence |
|---|---|---|
| | | TGCAGCTGGTGCAGTCTGGCGCCGAAGTGAAGAAACCCG<br>GCAGCAGCGTGAAGGTGTCCTGCAAGGCCAGCGGCTTCA<br>ACATCAAGGACACCTACATGCACTGGGTGCGCCAGGCCC<br>CTGGACAGGGACTGGAATGGATGGGCAGAATCGACCCCG<br>CCAACGGCAACAGCAAATACGTGCCCAAGTTCCAGGGCA<br>GAGTGACCATCACCGCCGACACCAGCACCTCCACCGCCT<br>ACATGGAACTGAGCAGCCTGCGGAGCGAGGACACCGCCG<br>TGTACTACTGTGCCCCCTTCGGCTACTACGTGTCCGACTA<br>CGCCATGGCCTATTGGGGCCAGGGCACACTCGTGACCGT<br>GTCCTCT |
| 43 | VLCL-Light chain (20H4.9) (nucleotide sequence) | see Table 1 |
| 81 | VHCH1-VHCH1 (20H4.9)-Heavy chain hole-VL (T84.66-LCHA) | QVQLQQWGAGLLKPSETLSLTCAVYGGSFSGYYWSWIRQS<br>PEKGLEWIGEINHGGYVTYNPSLESRVTISVDTSKNQFSLKLS<br>SVTAADTAVYYCARDYGPGNYDWYFDLWGRGTLVTVSSA<br>STKGPSVFPLAPSSKSTSGGTAALGCLVKDYFPEPVTVSWNS<br>GALTSGVHTFPAVLQSSGLYSLSSVVTVPSSSLGTQTYICNV<br>NHKPSNTKVDKKVEPKSCDGGGSGGGGSQVQLQQWGAG<br>LLKPSETLSLTCAVYGGSFSGYYWSWIRQSPEKGLEWIGEIN<br>HGGYVTYNPSLESRVTISVDTSKNQFSLKLSSVTAADTAVY<br>YCARDYGPGNYDWYFDLWGRGTLVTVSSASTKGPSVFPLA<br>PSSKSTSGGTAALGCLVKDYFPEPVTVSWNSGALTSGVHTFP<br>AVLQSSGLYSLSSVVTVPSSSLGTQTYICNVNHKPSNTKVDK<br>KVEPKSCDKTHTCPPCPAPEAAGGPSVFLFPPKPKDTLMISR<br>TPEVTCVVVDVSHEDPEVKFNWYVDGVEVHNAKTKPREEQ<br>YNSTYRVVSVLTVLHQDWLNGKEYKCKVSNKALGAPIEKTI<br>SKAKGQPREPQVCTLPPSRDELTKNQVSLSCAVKGFYPSDIA<br>VEWESNGQPENNYKTTPPVLDSDGSFFLVSKLTVDKSRWQQ<br>GNVFSCSVMHEALHNHYTQKSLSLSPGGGGSGGGGSGGG<br>GSGGGGSEIVLTQSPATLSLSPGERATLSCRAGESVDIFGVGF<br>LHWYQQKPGQAPRLLIYRASNRATGIPARFSGSGSGTDFTLT<br>ISSLEPEDFAVYYCQQTNEDPYTFGQGTKLEIK |
| 82 | VHCH1-VHCH1 (20H4.9)-Heavy chain knob-VH (T84.66-LCHA) | QVQLQQWGAGLLKPSETLSLTCAVYGGSFSGYYWSWIRQS<br>PEKGLEWIGEINHGGYVTYNPSLESRVTISVDTSKNQFSLKLS<br>SVTAADTAVYYCARDYGPGNYDWYFDLWGRGTLVTVSSA<br>STKGPSVFPLAPSSKSTSGGTAALGCLVKDYFPEPVTVSWNS<br>GALTSGVHTFPAVLQSSGLYSLSSVVTVPSSSLGTQTYICNV<br>NHKPSNTKVDKKVEPKSCDGGGSGGGGSQVQLQQWGAG<br>LLKPSETLSLTCAVYGGSFSGYYWSWIRQSPEKGLEWIGEIN<br>HGGYVTYNPSLESRVTISVDTSKNQFSLKLSSVTAADTAVY<br>YCARDYGPGNYDWYFDLWGRGTLVTVSSASTKGPSVFPLA<br>PSSKSTSGGTAALGCLVKDYFPEPVTVSWNSGALTSGVHTFP<br>AVLQSSGLYSLSSVVTVPSSSLGTQTYICNVNHKPSNTKVDK<br>KVEPKSCDKTHTCPPCPAPEAAGGPSVFLFPPKPKDTLMISR<br>TPEVTCVVVDVSHEDPEVKFNWYVDGVEVHNAKTKPREEQ<br>YNSTYRVVSVLTVLHQDWLNGKEYKCKVSNKALGAPIEKTI<br>SKAKGQPREPQVYTLPPCRDELTKNQVSLWCLVKGFYPSDI<br>AVEWESNGQPENNYKTTPPVLDSDGSFFLYSKLTVDKSRWQ<br>QGNVFSCSVMHEALHNHYTQKSLSLSPGGGGSGGGGSGG<br>GGSGGGGSQVQLVQSGAEVKKPGSSVKVSCKASGFNIKDTY<br>MHWVRQAPGQGLEWMGRIDPANGNSKYVPKFQGRVTITA<br>DTSTSTAYMELSSLRSEDTAVYYCAPFGYYVSDYAMAYWG<br>QGTLVTVSS |
| 46 | VLCL-Light chain (20H4.9) | see Table 1 |

TABLE 41

Sequences of bispecific, tetravalent anti-4-1BB/monovalent anti-CEA (T84.66-LCHA) human IgG1 P329GLALA antigen binding molecules (Constructs with a-CEA VH fused to Fc hole chain and VL fused to Fc knob chain, termed hole-VH)

| SEQ ID NO: | Description | Sequence |
|---|---|---|
| 83 | VHCH1-VHCH1 (20H4.9)-Heavy chain hole-VH (T84.66-LCHA) (nucleotide sequence) | CAGGTGCAGCTGCAGCAGTGGGGAGCCGGCCTGCTGAAG CCCAGCGAGACACTGAGCCTGACCTGCGCCGTGTACGGC GGCAGCTTCAGCGGCTACTACTGGTCCTGGATCCGGCAGA GCCCCGAGAAGGGCCTGGAATGGATCGGCGAGATCAACC ACGGCGGCTACGTGACCTACAACCCCAGCCTGGAAAGCA GAGTGACCATCAGCGTGGACACCAGCAAGAACCAGTTCA GCCTGAAGCTGAGCAGCGTGACAGCCGCCGACACCGCCG TGTACTACTGCGCCAGAGACTACGGCCTGGCAACTACG ACTGGTACTTCGACCTGTGGGGCAGAGGCACCCTGGTGA CAGTGTCCAGCGCTTCCACAAAGGGCCCCAGCGTGTTCC TCTGGCCCCTAGCAGCAAGAGCACATCTGGCGGAACAGC CGCCCTGGGCTGCCTCGTGAAGGACTACTTTCCCGAGCCC GTGACAGTGTCCTGGAACTCTGGCGCCCTGACAAGCGGC GTGCACACCTTTCCAGCCGTGCTGCAGAGCAGCGGCCTGT ACTCTCTGTCCAGCGTCGTGACTGTGCCCAGCAGCAGCCT GGGCACCCAGACCTACATCTGCAACGTGAACCACAAGCC CAGCAACACCAAGGTGGACAAGAAGGTGGAACCCAAGA GCTGCGACGGCGGAGGCGGATCTGGCGGCGGAGGATCCC AGGTGCAGCTGCAGCAGTGGGGAGCCGGCCTGCTGAAGC CCAGCGAGACACTGAGCCTGACCTGCGCCGTGTACGGCG GCAGCTTCAGCGGCTACTACTGGTCCTGGATCCGGCAGAG CCCCGAGAAGGGCCTGGAATGGATCGGCGAGATCAACCA CGGCGGCTACGTGACCTACAACCCCAGCCTGGAAAGCAG AGTGACCATCAGCGTGGACACCAGCAAGAACCAGTTCAG CCTGAAGCTGAGCAGCGTGACAGCCGCCGACACCGCCGT GTACTACTGCGCCAGAGACTACGGCCTGGCAACTACGA CTGGTACTTCGACCTGTGGGGCAGAGGCACCCTGGTGAC AGTGTCCAGCGCTAGCACCAAGGGCCCATCGGTCTTCCCC CTGGCACCCTCCTCCAAGAGCACCTCTGGGGGCACAGCG GCCCTGGGCTGCCTGGTCAAGGACTACTTCCCCGAACCGG TGACGGTGTCGTGGAACTCAGGCGCCCTGACCAGCGGCG TGCACACCTTCCCGGCTGTCCTACAGTCCTCAGGACTCTA CTCCCTCAGCAGCGTGGTGACCGTGCCCTCCAGCAGCTTG GGCACCCAGACCTACATCTGCAACGTGAATCACAAGCCC AGCAACACCAAGGTGGACAAGAAAGTTGAGCCCAAATCT TGTGACAAAACTCACACATGCCCACCGTGCCCAGCACCTG AAGCTGCAGGGGGACCGTCAGTCTTCCTCTTCCCCCCAAA ACCCAAGGACACCCTCATGATCTCCCGGACCCCTGAGGTC ACATGCGTGGTGGTGGACGTGAGCCACGAAGACCCTGAG GTCAAGTTCAACTGGTACGTGGACGGCGTGGAGGTGCAT AATGCCAAGACAAAGCCGCGGGAGGAGCAGTACAACAG CACGTACCGTGTGGTCAGCGTCCTCACCGTCCTGCACCAG GACTGGCTGAATGGCAAGGAGTACAAGTGCAAGGTCTCC AACAAAGCCCTCGGCGCCCCCATCGAGAAAACCATCTCC AAAGCCAAAGGGCAGCCCCGAGAACCACAGGTGTGCACC CTGCCCCCATCCCGGGATGAGCTGACCAAGAACCAGGTC AGCCTCTCGTGCGCAGTCAAAGGCTTCTATCCCAGCGACA TCGCCGTGGAGTGGGAGAGCAATGGGCAGCCGGAGAACA ACTACAAGACCACGCCTCCCGTGCTGGACTCCGACGGCTC CTTCTTCCTCGTGAGCAAGCTCACCGTGGACAAGAGCAGG TGGCAGCAGGGGAACGTCTTCTCATGCTCCGTGATGCATG AGGCTCTGCACAACCACTACACGCAGAAGAGCCTCTCCCT GTCTCCGGGTGGAGGCGGCGGAAGCGGAGGAGGAGGATC CGGCGGCGGAGGTTCCGGAGGCGGAGGATCCCAGGTGCA GCTGGTGCAGTCTGGCGCCGAAGTGAAGAAACCCGGCAG CAGCGTGAAGGTGTCCTGCAAGGCCAGCGGCTTCAACAT CAAGGACACCTACATGCACTGGGTGCGCCAGGCCCCTGG ACAGGGACTGGAATGGATGGGCAGAATCGACCCCGCCAA CGGCAACAGCAAATACGTGCCCAAGTTCCAGGGCAGAGT GACCATCACCGCCGACACCAGCACCTCCACCGCCTACATG GAACTGAGCAGCCTGCGGAGCGAGGACACCGCCGTGTAC TACTGTGCCCCCTTCGGCTACTACGTGTCCGACTACGCCA TGGCCTATTGGGGCCAGGGCACACTCGTGACCGTGTCCTC T |
| 84 | VHCH1-VHCH1 (20H4.9)-Heavy chain knob-VL (T84.66-LCHA) (nucleotide sequence) | CAGGTGCAGCTGCAGCAGTGGGGAGCCGGCCTGCTGAAG CCCAGCGAGACACTGAGCCTGACCTGCGCCGTGTACGGC GGCAGCTTCAGCGGCTACTACTGGTCCTGGATCCGGCAGA GCCCCGAGAAGGGCCTGGAATGGATCGGCGAGATCAACC ACGGCGGCTACGTGACCTACAACCCCAGCCTGGAAAGCA GAGTGACCATCAGCGTGGACACCAGCAAGAACCAGTTCA GCCTGAAGCTGAGCAGCGTGACAGCCGCCGACACCGCCG TGTACTACTGCGCCAGAGACTACGGCCTGGCAACTACG |

TABLE 41 -continued

Sequences of bispecific, tetravalent anti-4-1BB/monovalent anti-CEA (T84.66-LCHA) human IgG1 P329GLALA antigen binding molecules (Constructs with a-CEA VH fused to Fc hole chain and VL fused to Fc knob chain, termed hole-VH)

| SEQ ID NO: | Description | Sequence |
|---|---|---|
| | | ACTGGTACTTCGACCTGTGGGGCAGAGGCACCCTGGTGA
CAGTGTCCAGCGCTTCCACAAAGGGCCCCAGCGTGTTCCC
TCTGGCCCCTAGCAGCAAGAGCACATCTGGCGGAACAGC
CGCCCTGGGCTGCCTCGTGAAGGACTACTTTCCCGAGCCC
GTGACAGTGTCCTGGAACTCTGGCGCCCTGACAAGCGGC
GTGCACACCTTTCCAGCCGTGCTGCAGAGCAGCGGCCTGT
ACTCTCTGTCCAGCGTCGTGACTGTGCCCAGCAGCAGCCT
GGGCACCCAGACCTACATCTGCAACGTGAACCACAAGCC
CAGCAACACCAAGGTGGACAAGAAGGTGGAACCCAAGA
GCTGCGACGGCGGAGGCGGATCTGGCGGCGGAGGATCCC
AGGTGCAGCTGCAGCAGTGGGGAGCCGGCCTGCTGAAGC
CCAGCGAGACACTGAGCCTGACCTGCGCCGTGTACGGCG
GCAGCTTCAGCGGCTACTACTGGTCCTGGATCCGGCAGAG
CCCCGAGAAGGGCCTGGAATGGATCGGCGAGATCAACCA
CGGCGGCTACGTGACCTACAACCCCAGCCTGGAAAGCAG
AGTGACCATCAGCGTGGACACCAGCAAGAACCAGTTCAG
CCTGAAGCTGAGCAGCGTGACAGCCGCCGACACCGCCGT
GTACTACTGCGCCAGAGACTACGGCCCTGGCAACTACGA
CTGGTACTTCGACCTGTGGGGCAGAGGCACCCTGGTGAC
AGTGTCCAGCGCTAGCACCAAGGGCCCATCGGTCTTCCCC
CTGGCACCCTCCTCCAAGAGCACCTCTGGGGGCACAGCG
GCCCTGGGCTGCCTGGTCAAGGACTACTTCCCCGAACCGG
TGACGGTGTCGTGGAACTCAGGCGCCCTGACCAGCGGCG
TGCACACCTTCCCGGCTGTCCTACAGTCCTCAGGACTCTA
CTCCCTCAGCAGCGTGGTGACCGTGCCCTCCAGCAGCTTG
GGCACCCAGACCTACATCTGCAACGTGAATCACAAGCCC
AGCAACACCAAGGTGGACAAGAAAGTTGAGCCCAAATCT
TGTGACAAAACTCACACATGCCCACCGTGCCCAGCACCTG
AAGCTGCAGGGGGACCGTCAGTCTTCCTCTTCCCCCCAAA
ACCCAAGGACACCCTCATGATCTCCCGGACCCCTGAGGTC
ACATGCGTGGTGGTGGACGTGAGCCACGAAGACCCTGAG
GTCAAGTTCAACTGGTACGTGGACGGCGTGGAGGTGCAT
AATGCCAAGACAAAGCCGCGGGAGGAGCAGTACAACAG
CACGTACCGTGTGGTCAGCGTCCTCACCGTCCTGCACCAG
GACTGGCTGAATGGCAAGGAGTACAAGTGCAAGGTCTCC
AACAAAGCCCTCGGCGCCCCCATCGAGAAAACCATCTCC
AAAGCCAAAGGGCAGCCCCGAGAACCACAGGTGTACACC
CTGCCCCCCTGCAGAGATGAGCTGACCAAGAACCAGGTG
TCCCTGTGGTGTCTGGTCAAGGGCTTCTACCCCAGCGATA
TCGCCGTGGAGTGGGAGAGCAACGGCCAGCCTGAGAACA
ACTACAAGACCACCCCCCCTGTGCTGGACAGCGACGGCA
GCTTCTTCCTGTACTCCAAACTGACCGTGGACAAGAGCCG
GTGGCAGCAGGGCAACGTGTTCAGCTGCAGCGTGATGCA
CGAGGCCCTGCACAACCACTACACCCAGAAGTCCCTGAG
CCTGAGCCCCGGCGGAGGCGGCGGAAGCGGAGGAGGAG
GATCTGGGGGCGGAGGTTCCGGAGGCGGTGGATCTGAGA
TCGTGCTGACCCAGAGCCCTGCCACCCTGTCACTGTCTCC
AGGCGAGAGAGCCACCCTGAGCTGTAGAGCCGGCGAGAG
CGTGGACATCTTCGGCGTGGGATTCTGCACTGGTATCAG
CAGAAGCCCGGCCAGGCCCCCAGACTGCTGATCTACAGA
GCCAGCAACCGGGCCACAGGCATCCCCGCCAGATTTCTG
GCTCTGGCAGCGGCACCGACTTCACCCTGACAATCAGCA
GCCTGGAACCCGAGGACTTCGCCGTGTACTACTGCCAGCA
GACCAACGAGGACCCCTACACCTTTGGCCAGGGCACCAA
GCTGGAAATCAAG |
| 43 | VLCL-Light chain (20H4.9) (nucleotide sequence) | see Table 1 |
| 85 | VHCH1-VHCH1 (20H4.9)-Heavy chain hole-VH (T84.66-LCHA) | QVQLQQWGAGLLKPSETLSLTCAVYGGSFSGYYWSWIRQS
PEKGLEWIGEINHGGYVTYNPSLESRVTISVDTSKNQFSLKLS
SVTAADTAVYYCARDYGPGNYDWYFDLWGRGTLVTVSSA
STKGPSVFPLAPSSKSTSGGTAALGCLVKDYFPEPVTVSWNS
GALTSGVHTFPAVLQSSGLYSLSSVVTVPSSSLGTQTYICNV
NHKPSNTKVDKKVEPKSCDGGGSGGGGSQVQLQQWGAG
LLKPSETLSLTCAVYGGSFSGYYWSWIRQSPEKGLEWIGEIN
HGGYVTYNPSLESRVTISVDTSKNQFSLKLSSVTAADTAVY
YCARDYGPGNYDWYFDLWGRGTLVTVSSASTKGPSVFPLA
PSSKSTSGGTAALGCLVKDYFPEPVTVSWNSGALTSGVHTFP
AVLQSSGLYSLSSVVTVPSSSLGTQTYICNVNHKPSNTKVDK
KVEPKSCDKTHTCPPCPAPEAAGGPSVFLFPPKPKDTLMISR |

TABLE 41 -continued

Sequences of bispecific, tetravalent anti-4-1BB/monovalent anti-CEA (T84.66-LCHA) human IgG1 P329GLALA antigen binding molecules (Constructs with a-CEA VH fused to Fc hole chain and VL fused to Fc knob chain, termed hole-VH)

| SEQ ID NO: | Description | Sequence |
|---|---|---|
|  |  | TPEVTCVVVDVSHEDPEVKFNWYVDGVEVHNAKTKPREEQ YNSTYRVVSVLTVLHQDWLNGKEYKCKVSNKALGAPIEKTI SKAKGQPREPQVCTLPPSRDELTKNQVSLSCAVKGFYPSDIA VEWESNGQPENNYKTTPPVLDSDGSFFLVSKLTVDKSRWQQ GNVFSCSVMHEALHNHYTQKSLSLSPGGGGSGGGGSGGG GSGGGGSQVQLVQSGAEVKKPGSSVKVSCKASGFNIKDTY MHWVRQAPGQGLEWMGRIDPANGNSKYVPKFQGRVTITA DTSTSTAYMELSSLRSEDTAVYYCAPFGYYVSDYAMAYWG QGTLVTVSS |
| 86 | VHCH1-VHCH1 (20H4.9)-Heavy chain knob-VL (T84.66-LCHA) | QVQLQQWGAGLLKPSETLSLTCAVYGGSFSGYYWSWIRQS PEKGLEWIGEINHGGYVTYNPSLESRVTISVDTSKNQFSLKLS SVTAADTAVYYCARDYGPGNYDWYFDLWGRGTLVTVSSA STKGPSVFPLAPSSKSTSGGTAALGCLVKDYFPEPVTVSWNS GALTSGVHTFPAVLQSSGLYSLSSVVTVPSSSLGTQTYICNV NHKPSNTKVDKKVEPKSCDGGGSGGGGSQVQLQQWGAG LLKPSETLSLTCAVYGGSFSGYYWSWIRQSPEKGLEWIGEIN HGGYVTYNPSLESRVTISVDTSKNQFSLKLSSVTAADTAVY YCARDYGPGNYDWYFDLWGRGTLVTVSSASTKGPSVFPLA PSSKSTSGGTAALGCLVKDYFPEPVTVSWNSGALTSGVHTFP AVLQSSGLYSLSSVVTVPSSSLGTQTYICNVNHKPSNTKVDK KVEPKSCDKTHTCPPCPAPEAAGGPSVFLFPPKPKDTLMISR TPEVTCVVVDVSHEDPEVKFNWYVDGVEVHNAKTKPREEQ YNSTYRVVSVLTVLHQDWLNGKEYKCKVSNKALGAPIEKTI SKAKGQPREPQVYTLPPCRDELTKNQVSLWCLVKGFYPSDI AVEWESNGQPENNYKTTPPVLDSDGSFFLYSKLTVDKSRWQ QGNVFSCSVMHEALHNHYTQKSLSLSPGGGGSGGGGSGG GGSGGGGSEIVLTQSPATLSLSPGERATLSCRAGESVDIFGVG FLHWYQQKPGQAPRLLIYRASNRATGIPARFSGSGSGTDFTL TISSLEPEDFAVYYCQQTNEDPYTFGQGTKLEIK |
| 46 | VLCL-Light chain (20H4.9) | see Table 1 |

The base pair and amino acid sequences for 4+1 anti-4-1BB, anti-CEA (A5B7) constructs with a-CEA VH fused to the Fc knob heavy chain and VL fused to Fc hole heavy chain can be found respectively in Table 42. The base pair and amino acid sequences for 4+1 anti-4-1BB, anti-CEA (A5B7) constructs with a-CEA VL fused to Fc knob heavy chain and VH fused to Fc hole heavy chain can be found respectively in Table 43.

TABLE 42

Sequences of bispecific, tetravalent anti-4-1BB/monovalent anti-CEA (A5B7) human IgG1 P329GLALA antigen binding molecules (Constructs with a-CEA VL fused to Fc hole chain and VH fused to Fc knob chain, termed hole-VL)

| SEQ ID NO: | Description | Sequence |
|---|---|---|
| 87 | VHCH1-VHCH1 (20H4.9)-Heavy chain hole-VL(A5B7) (nucleotide sequence) | CAGGTGCAGCTGCAGCAGTGGGGAGCCGGCCTGCTGAAG CCCAGCGAGACACTGAGCCTGACCTGCGCCGTGTACGGC GGCAGCTTCAGCGGCTACTACTGGTCCTGGATCCGGCAGA GCCCCGAGAAGGGCCTGGAATGGATCGGCGAGATCAACC ACGGCGGCTACGTGACCTACAACCCCAGCCTGGAAAGCA GAGTGACCATCAGCGTGGACACCAGCAAGAACCAGTTCA GCCTGAAGCTGAGCAGCGTGACAGCCGCCGACACCGCCG TGTACTACTGCGCCAGAGACTACGGCCCTGGCAACTACG ACTGGTACTTCGACCTGTGGGGCAGAGGCACCCTGGTGA CAGTGTCCAGCGCTTCTACCAAGGGCCCCAGCGTGTTCCC TCTGGCCCCTAGCAGCAAGAGCACATCTGGCGGAACAGC CGCCCTGGGCTGCCTCGTGAAGGACTACTTTCCCGAGCCC GTGACAGTGTCCTGGAACTCTGGCGCCCTGACAAGCGGC GTGCACACCTTTCCAGCCGTGCTGCAGAGCAGCGGCCTGT ACTCTCTGAGCAGCGTCGTGACTGTGCCCAGCAGCAGCCT GGGAACCCAGACCTACATCTGCAACGTGAACCACAAGCC CAGCAACACCAAGGTGGACAAGAAGGTGGAACCCAAGA GCTGCGACGGCGGAGGCGGATCTGGCGGCGGAGGATCC CAGGTGCAGCTGCAGCAGTGGGGAGCCGGCCTGCTGAAG CCCAGCGAGACACTGAGCCTGACCTGCGCCGTGTACGGC GGCAGCTTCAGCGGCTACTACTGGTCCTGGATCCGGCAGA GCCCCGAGAAGGGCCTGGAATGGATCGGCGAGATCAACC |

TABLE 42 -continued

Sequences of bispecific, tetravalent anti-4-1BB/monovalent anti-CEA (A5B7) human IgG1 P329GLALA antigen binding molecules (Constructs with a-CEA VL fused to Fc hole chain and VH fused to Fc knob chain, termed hole-VL)

| SEQ ID NO: | Description | Sequence |
|---|---|---|
| | | ACGGCGGCTACGTGACCTACAACCCCAGCCTGGAAAGCA GAGTGACCATCAGCGTGGACACCAGCAAGAACCAGTTCA GCCTGAAGCTGAGCAGCGTGACAGCCGCCGACACCGCCG TGTACTACTGCGCCAGAGACTACGGCCCTGGCAACTACG ACTGGTACTTCGACCTGTGGGGCAGAGGCACCCTGGTGA CAGTGTCCAGCGCTAGCACCAAGGGCCCATCGGTCTTCC CCCTGGCACCCTCCTCCAAGAGCACCTCTGGGGGCACAGC GGCCCTGGGCTGCCTGGTCAAGGACTACTTCCCCGAACCG GTGACGGTGTCGTGGAACTCAGGCGCCCTGACCAGCGGC GTGCACACCTTCCCGGCTGTCCTACAGTCCTCAGGACTCT ACTCCCTCAGCAGCGTGGTGACCGTGCCCTCCAGCAGCTT GGGCACCCAGACCTACATCTGCAACGTGAATCACAAGCC CAGCAACACCAAGGTGGACAAGAAAGTTGAGCCCAAATC TTGTGACAAAACTCACACATGCCCACCGTGCCCAGCACCT GAAGCTGCAGGGGACCGTCAGTCTTCCTCTTCCCCCCAA AACCCAAGGACACCCTCATGATCTCCCGGACCCCTGAGGT CACATGCGTGGTGGTGGACGTGAGCCACGAAGACCCTGA GGTCAAGTTCAACTGGTACGTGGACGGCGTGGAGGTGCA TAATGCCAAGACAAAGCCGCGGGAGGAGCAGTACAACAG CACGTACCGTGTGGTCAGCGTCCTCACCGTCCTGCACCAG GACTGGCTGAATGGCAAGGAGTACAAGTGCAAGGTCTCC AACAAAGCCCTCGGCGCCCCCATCGAGAAAACCATCTCC AAAGCCAAAGGGCAGCCCCGAGAACCACAGGTGTGCACC CTGCCCCCATCCCGGGATGAGCTGACCAAGAACCAGGTC AGCCTCTCGTGCGCAGTCAAAGGCTTCTATCCCAGCGACA TCGCCGTGGAGTGGGAGAGCAATGGGCAGCCGGAGAACA ACTACAAGACCACGCCTCCCGTGCTGGACTCCGACGGCTC CTTCTTCCTCGTGAGCAAGCTCACCGTGGACAAGAGCAGG TGGCAGCAGGGGAACGTCTTCTCATGCTCCGTGATGCATG AGGCTCTGCACAACCACTACACGCAGAAGAGCCTCTCCCT GTCTCCGGGTGGAGGCGGCGGAAGCGGAGGAGGAGGATC CGGCGGCGGAGGTTCCGGAGGCGGAGGATCCCAGGCCGT GCTGACACAGCCTGCCAGCCTGTCTGCTTCTCCTGGCGCC TCTGCCTCCCTGACCTGCACACTGAGAAGAGGCATCAACG TGGGCGCCTACAGCATCTACTGGTATCAGCAGAAGCCCG GCAGCCCCCCTCAGTACCTGCTGAGATACAAGAGCGACA GCGACAAGCAGCAGGGCAGCGGCGTGTCCAGCAGATTCA GCGCCAGCAAGGACGCCTCTGCCAACGCCGGAATCCTGC TGATCAGCGGCCTGCAGTCTGAGGACGAGGCCGACTACT ACTGCATGATCTGGCACTCTGGCGCCAGCGCCGTGTTTGG CGGAGGCACAAAACTGACCGTGCTG |
| 88 | VHCH1-VHCH1 (20H4.9)-Heavy chain knob-VH(A5B7) (nucleotide sequence) | CAGGTGCAGCTGCAGCAGTGGGGAGCCGGCCTGCTGAAG CCCAGCGAGACACTGAGCCTGACCTGCGCCGTGTACGGC GGCAGCTTCAGCGGCTACTACTGGTCCTGGATCCGGCAGA GCCCCGAGAAGGGCCTGGAATGGATCGGCGAGATCAACC ACGGCGGCTACGTGACCTACAACCCCAGCCTGGAAAGCA GAGTGACCATCAGCGTGGACACCAGCAAGAACCAGTTCA GCCTGAAGCTGAGCAGCGTGACAGCCGCCGACACCGCCG TGTACTACTGCGCCAGAGACTACGGCCCTGGCAACTACG ACTGGTACTTCGACCTGTGGGGCAGAGGCACCCTGGTGA CAGTGTCCAGCGCTTCTACCAAGGGCCCCAGCGTGTTCCC TCTGGCCCCTAGCAGCAAGAGCACATCTGGCGGAACAGC CGCCCTGGGCTGCCTCGTGAAGGACTACTTTCCCGAGCCC GTGACAGTGTCCTGGAACTCTGGCGCCCTGACAAGCGGC GTGCACACCTTTCCAGCCGTGCTGCAGAGCAGCGGCCTGT ACTCTCTGAGCAGCGTCGTGACTGTGCCCAGCAGCAGCCT GGGAACCCAGACCTACATCTGCAACGTGAACCACAAGCC CAGCAACACCAAGGTGGACAAGAAGGTGGAACCCAAGA GCTGCGACGGCGGAGGCGGATCTGGCGGCGGAGGATCCC AGGTGCAGCTGCAGCAGTGGGAGCCGGCCTGCTGAAGC CCAGCGAGACACTGAGCCTGACCTGCGCCGTGTACGGCG GCAGCTTCAGCGGCTACTACTGGTCCTGGATCCGGCAGAG CCCCGAGAAGGGCCTGGAATGGATCGGCGAGATCAACCA CGGCGGCTACGTGACCTACAACCCCAGCCTGGAAAGCAG AGTGACCATCAGCGTGGACACCAGCAAGAACCAGTTCAG CCTGAAGCTGAGCAGCGTGACAGCCGCCGACACCGCCGT GTACTACTGCGCCAGAGACTACGGCCCTGGCAACTACGA CTGGTACTTCGACCTGTGGGGCAGAGGCACCCTGGTGAC AGTGTCCAGCGCTAGCACCAAGGGCCCATCGGTCTTCCCC CTGGCACCCTCCTCCAAGAGCACCTCTGGGGGCACAGCG GCCCTGGGCTGCCTGGTCAAGGACTACTTCCCCGAACCGG TGACGGTGTCGTGGAACTCAGGCGCCCTGACCAGCGGCG |

TABLE 42 -continued

Sequences of bispecific, tetravalent anti-4-1BB/monovalent anti-CEA (A5B7) human IgG1 P329GLALA antigen binding molecules (Constructs with a-CEA VL fused to Fc hole chain and VH fused to Fc knob chain, termed hole-VL)

| SEQ ID NO: | Description | Sequence |
|---|---|---|
|  |  | TGCACACCTTCCCGGCTGTCCTACAGTCCTCAGGACTCTA<br>CTCCCTCAGCAGCGTGGTGACCGTGCCCTCCAGCAGCTTG<br>GGCACCCAGACCTACATCTGCAACGTGAATCACAAGCCC<br>AGCAACACCAAGGTGGACAAGAAAGTTGAGCCCAAATCT<br>TGTGACAAAACTCACACATGCCCACCGTGCCCAGCACCTG<br>AAGCTGCAGGGGGACCGTCAGTCTTCCTCTTCCCCCCAAA<br>ACCCAAGGACACCCTCATGATCTCCCGGACCCCTGAGGTC<br>ACATGCGTGGTGGTGGACGTGAGCCACGAAGACCCTGAG<br>GTCAAGTTCAACTGGTACGTGGACGGCGTGGAGGTGCAT<br>AATGCCAAGACAAAGCCGCGGGAGGAGCAGTACAACAG<br>CACGTACCGTGTGGTCAGCGTCCTCACCGTCCTGCACCAG<br>GACTGGCTGAATGGCAAGGAGTACAAGTGCAAGGTCTCC<br>AACAAAGCCCTCGGCGCCCCCATCGAGAAAACCATCTCC<br>AAAGCCAAAGGGCAGCCCCGAGAACCACAGGTGTACACC<br>CTGCCCCCCTGCAGAGATGAGCTGACCAAGAACCAGGTG<br>TCCCTGTGGTGTCTGGTCAAGGGCTTCTACCCCAGCGATA<br>TCGCCGTGGAGTGGGAGAGCAACGGCCAGCCTGAGAACA<br>ACTACAAGACCACCCCCCCTGTGCTGGACAGCGACGGCA<br>GCTTCTTCCTGTACTCCAAACTGACCGTGGACAAGAGCCG<br>GTGGCAGCAGGGCAACGTGTTCAGCTGCAGCGTGATGCA<br>CGAGGCCCTGCACAACCACTACACCCAGAAGTCCCTGAG<br>CCTGAGCCCCGGCGGAGGCGGCGGAAGCGGAGGAGGAG<br>GATCTGGGGGCGGAGGTTCCGGAGGCGGTGGATCTGAAG<br>TGCAGCTGGTGGAATCTGGCGGCGGACTGGTGCAGCCTG<br>GCAGAAGCCTGAGACTGAGCTGTGCCGCCAGCGGCTTTA<br>CCGTGTCCAGCTACTGGATGCACTGGGTCCGACAGGCCCC<br>TGGCAAGGGACTGGAATGGGTCGGATTCATCAGAAACAA<br>GGCCAACGGCGGCACCACCGAGTACGCCGCCTCTGTGAA<br>GGGCCGGTTCACCATCAGCCGGGACGACAGCAAGAACAC<br>CCTGTACCTGCAGATGAACAGCCTGCGGGCCGAGGACAC<br>CGCCGTGTACTACTGCGCCAGAGACAGAGGCCTGCGGTT<br>CTACTTCGACTACTGGGGCCAGGGCACCACCGTGACAGTC<br>TCTTCC |
| 43 | VLCL-Light chain (20H4.9) (nucleotide sequence) | see Table 1 |
| 89 | VHCH1-VHCH1 (20H4.9)-Heavy chain hole-VL (A5B7) | QVQLQQWGAGLLKPSETLSLTCAVYGGSFSGYYWSWIRQS<br>PEKGLEWIGEINHGGYVTYNPSLESRVTISVDTSKNQFSLKLS<br>SVTAADTAVYYCARDYGPGNYDWYFDLWGRGTLVTVSSA<br>STKGPSVFPLAPSSKSTSGGTAALGCLVKDYFPEPVTVSWNS<br>GALTSGVHTFPAVLQSSGLYSLSSVVTVPSSSLGTQTYICNV<br>NHKPSNTKVDKKVEPKSCDGGGGSGGGGSQVQLQQWGAG<br>LLKPSETLSLTCAVYGGSFSGYYWSWIRQSPEKGLEWIGEIN<br>HGGYVTYNPSLESRVTISVDTSKNQFSLKLSSVTAADTAVY<br>YCARDYGPGNYDWYFDLWGRGTLVTVSSASTKGPSVFPLA<br>PSSKSTSGGTAALGCLVKDYFPEPVTVSWNSGALTSGVHTFP<br>AVLQSSGLYSLSSVVTVPSSSLGTQTYICNVNHKPSNTKVDK<br>KVEPKSCDKTHTCPPCPAPEAAGGPSVFLFPPKPKDTLMISR<br>TPEVTCVVVDVSHEDPEVKFNWYVDGVEVHNAKTKPREEQ<br>YNSTYRVVSVLTVLHQDWLNGKEYKCKVSNKALGAPIEKTI<br>SKAKGQPREPQVCTLPPSRDELTKNQVSLSCAVKGFYPSDIA<br>VEWESNGQPENNYKTTPPVLDSDGSFFLVSKLTVDKSRWQQ<br>GNVFSCSVMHEALHNHYTQKSLSLSPGGGGGSGGGGSGGG<br>GSGGGGSQAVLTQPASLSASPGASASLTCTLRRGINVGAYSI<br>YWYQQKPGSPPQYLLRYKSDSDKQQGSGVSSRFSASKDASA<br>NAGILLISGLQSEDEADYYCMIWHSGASAVFGGGTKLTVL |
| 90 | VHCH1-VHCH1 (20H4.9)-Heavy chain knob-VH (A5B7) | QVQLQQWGAGLLKPSETLSLTCAVYGGSFSGYYWSWIRQS<br>PEKGLEWIGEINHGGYVTYNPSLESRVTISVDTSKNQFSLKLS<br>SVTAADTAVYYCARDYGPGNYDWYFDLWGRGTLVTVSSA<br>STKGPSVFPLAPSSKSTSGGTAALGCLVKDYFPEPVTVSWNS<br>GALTSGVHTFPAVLQSSGLYSLSSVVTVPSSSLGTQTYICNV<br>NHKPSNTKVDKKVEPKSCDGGGGSGGGGSQVQLQQWGAG<br>LLKPSETLSLTCAVYGGSFSGYYWSWIRQSPEKGLEWIGEIN<br>HGGYVTYNPSLESRVTISVDTSKNQFSLKLSSVTAADTAVY<br>YCARDYGPGNYDWYFDLWGRGTLVTVSSASTKGPSVFPLA<br>PSSKSTSGGTAALGCLVKDYFPEPVTVSWNSGALTSGVHTFP<br>AVLQSSGLYSLSSVVTVPSSSLGTQTYICNVNHKPSNTKVDK<br>KVEPKSCDKTHTCPPCPAPEAAGGPSVFLFPPKPKDTLMISR<br>TPEVTCVVVDVSHEDPEVKFNWYVDGVEVHNAKTKPREEQ |

TABLE 42 -continued

Sequences of bispecific, tetravalent anti-4-1BB/monovalent anti-CEA (A5B7) human IgG1 P329GLALA antigen binding molecules (Constructs with a-CEA VL fused to Fc hole chain and VH fused to Fc knob chain, termed hole-VL)

| SEQ ID NO: | Description | Sequence |
|---|---|---|
| | | YNSTYRVVSVLTVLHQDWLNGKEYKCKVSNKALGAPIEKTI SKAKGQPREPQVYTLPPCRDELTKNQVSLWCLVKGFYPSDI AVEWESNGQPENNYKTTPPVLDSDGSFFLYSKLTVDKSRWQ QGNVFSCSVMHEALHNHYTQKSLSLSPGGGGGSGGGGSGG GGSGGGGSEVQLVESGGGLVQPGRSLRLSCAASGFTVSSYW MHWVRQAPGKGLEWVGFIRNKANGGTTEYAASVKGRFTIS RDDSKNTLYLQMNSLRAEDTAVYYCARDRGLRFYFDYWG QGTTVTVSS |
| 46 | VLCL-Light chain (20H4.9) | see Table 1 |

TABLE 43

Sequences of bispecific, tetravalent anti-4-1BB/monovalent anti-CEA (A5B7) human IgG1 P329GLALA antigen binding molecules (Constructs with a-CEA VH fused to Fc hole chain and VL fused to Fc knob chain, termed hole-VH)

| SEQ ID NO: | Description | Sequence |
|---|---|---|
| 91 | VHCH1-VHCH1 (20H4.9)-Heavy chain hole-VH (A5B7) (nucleotide sequence) | CAGGTGCAGCTGCAGCAGTGGGGAGCCGGCCTGCTGAAG CCCAGCGAGACACTGAGCCTGACCTGCGCCGTGTACGGC GGCAGCTTCAGCGGCTACTACTGGTCCTGGATCCGGCAGA GCCCCGAGAAGGGCCTGGAATGGATCGGCGAGATCAACC ACGGCGGCTACGTGACCTACAACCCCAGCCTGGAAAGCA GAGTGACCATCAGCGTGGACACCAGCAAGAACCAGTTCA GCCTGAAGCTGAGCAGCGTGACAGCCGCCGACACCGCCG TGTACTACTGCGCCAGAGACTACGGCCCTGGCAACTACG ACTGGTACTTCGACCTGTGGGGCAGAGGCACCCTGGTGA CAGTGTCCAGCGCTTCCACAAAGGGCCCCAGCGTGTTCC TCTGGCCCCTAGCAGCAAGAGCACATCTGGCGGAACAGC CGCCCTGGGCTGCCTCGTGAAGGACTACTTTCCCGAGCCC GTGACAGTGTCCTGGAACTCTGGCGCCCTGACAAGCGGC GTGCACACCTTTCCAGCCGTGCTGCAGAGCAGCGGCCTGT ACTCTCTGTCCAGCGTCGTGACTGTGCCCAGCAGCAGCCT GGGCACCCAGACCTACATCTGCAACGTGAACCACAAGCC CAGCAACACCAAGGTGGACAAGAAGGTGGAACCCAAGA GCTGCGACGGCGGAGGCGGATCTGGCGGCGGAGGATCCC AGGTGCAGCTGCAGCAGTGGGGAGCCGGCCTGCTGAAGC CCAGCGAGACACTGAGCCTGACCTGCGCCGTGTACGGCG GCAGCTTCAGCGGCTACTACTGGTCCTGGATCCGGCAGAG CCCCGAGAAGGGCCTGGAATGGATCGGCGAGATCAACCA CGGCGGCTACGTGACCTACAACCCCAGCCTGGAAAGCAG AGTGACCATCAGCGTGGACACCAGCAAGAACCAGTTCAG CCTGAAGCTGAGCAGCGTGACAGCCGCCGACACCGCCGT GTACTACTGCGCCAGAGACTACGGCCCTGGCAACTACGA CTGGTACTTCGACCTGTGGGGCAGAGGCACCCTGGTGAC AGTGTCCAGCGCTAGCACCAAGGGCCCATCGGTCTTCCCC CTGGCACCCTCCTCCAAGAGCACCTCTGGGGGCACAGCG GCCCTGGGCTGCCTGGTCAAGGACTACTTCCCCGAACCGG TGACGGTGTCGTGGAACTCAGGCGCCCTGACCAGCGGCG TGCACACCTTCCCGGCTGTCCTACAGTCCTCAGGACTCTA CTCCCTCAGCAGCGTGGTGACCGTGCCCTCCAGCAGCTTG GGCACCCAGACCTACATCTGCAACGTGAATCACAAGCCC AGCAACACCAAGGTGGACAAGAAAGTTGAGCCCAAATCT TGTGACAAAACTCACACATGCCCACCGTGCCCAGCACCTG AAGCTGCAGGGGGACCGTCAGTCTTCCTCTTCCCCCCAAA ACCCAAGGACACCCTCATGATCTCCCGGACCCCTGAGGTC ACATGCGTGGTGGTGGACGTGAGCCACGAAGACCCTGAG GTCAAGTTCAACTGGTACGTGGACGGCGTGGAGGTGCAT AATGCCAAGACAAAGCCGCGGGAGGAGCAGTACAACAG CACGTACCGTGTGGTCAGCGTCCTCACCGTCCTGCACCAG GACTGGCTGAATGGCAAGGAGTACAAGTGCAAGGTCTCC AACAAAGCCCTCGGCGCCCCCATCGAGAAAACCATCTCC AAAGCCAAAGGGCAGCCCCGAGAACCACAGGTGTGCACC CTGCCCCCATCCCGGGATGAGCTGACCAAGAACCAGGTC AGCCTCTCGTGCGCAGTCAAAGGCTTCTATCCCAGCGACA TCGCCGTGGAGTGGGAGAGCAATGGGCAGCCGGAGAACA ACTACAAGACCACGCCTCCCGTGCTGGACTCCGACGGCTC |

TABLE 43 -continued

Sequences of bispecific, tetravalent anti-4-1BB/monovalent anti-CEA (A5B7) human IgG1 P329GLALA antigen binding molecules (Constructs with a-CEA VH fused to Fc hole chain and VL fused to Fc knob chain, termed hole-VH)

| SEQ ID NO: | Description | Sequence |
|---|---|---|
|  |  | CTTCTTCCTCGTGAGCAAGCTCACCGTGGACAAGAGCAGG TGGCAGCAGGGGAACGTCTTCTCATGCTCCGTGATGCATG AGGCTCTGCACAACCACTACACGCAGAAGAGCCTCTCCCT GTCTCCGGGTGGAGGCGGCGGAAGCGGAGGAGGAGGATC CGGCGGCGGAGGTTCCGGAGGCGGAGGATCCGAAGTGCA GCTGGTGGAATCTGGCGGCGGACTGGTGCAGCCTGGCAG AAGCCTGAGACTGAGCTGTGCCGCCAGCGGCTTTACCGTG TCCAGCTACTGGATGCACTGGGTCCGACAGGCCCCTGGCA AGGGACTGGAATGGGTCGGATTCATCAGAAACAAGGCCA ACGGCGGCACCACCGAGTACGCCGCCTCTGTGAAGGGCC GGTTCACCATCAGCCGGGACGACAGCAAGAACACCCTGT ACCTGCAGATGAACAGCCTGCGGGCCGAGGACACCGCCG TGTACTACTGCGCCAGAGACAGAGGCCTGCGGTTCTACTT CGACTACTGGGGCCAGGGCACCACCGTGACAGTCTCTTCC |
| 92 | VHCH1-VHCH1 (20H4.9)-Heavy chain knob-VL (A5B7) (nucleotide sequence) | CAGGTGCAGCTGCAGCAGTGGGGAGCCGGCCTGCTGAAG CCCAGCGAGACACTGAGCCTGACCTGCGCCGTGTACGGC GGCAGCTTCAGCGGCTACTACTGGTCCTGGATCCGGCAGA GCCCCGAGAAGGGCCTGGAATGGATCGGCGAGATCAACC ACGGCGGCTACGTGACCTACAACCCCAGCCTGGAAAGCA GAGTGACCATCAGCGTGGACACCAGCAAGAACCAGTTCA GCCTGAAGCTGAGCAGCGTGACAGCCGCCGACACCGCCG TGTACTACTGCGCCAGAGACTACGGCCCTGGCAACTACG ACTGGTACTTCGACCTGTGGGGCAGAGGCACCCTGGTGA CAGTGTCCAGCGCTTCCACAAAGGGCCCCAGCGTGTTCC TCTGGCCCCTAGCAGCAAGAGCACATCTGGCGGAACAGC CGCCCTGGGCTGCCTCGTGAAGGACTACTTTCCCGAGCCC GTGACAGTGTCCTGGAACTCTGGCGCCCTGACAAGCGGC GTGCACACCTTTCCAGCCGTGCTGCAGAGCAGCGGCCTGT ACTCTCTGTCCAGCGTCGTGACTGTGCCCAGCAGCAGCCT GGGCACCCAGACCTACATCTGCAACGTGAACCACAAGCC CAGCAACACCAAGGTGGACAAGAAGGTGGAACCCAAGA GCTGCGACGGCGGAGGCGGATCTGGCGGCGGAGGATCCC AGGTGCAGCTGCAGCAGTGGGGAGCCGGCCTGCTGAAGC CCAGCGAGACACTGAGCCTGACCTGCGCCGTGTACGGCG GCAGCTTCAGCGGCTACTACTGGTCCTGGATCCGGCAGAG CCCCGAGAAGGGCCTGGAATGGATCGGCGAGATCAACCA CGGCGGCTACGTGACCTACAACCCCAGCCTGGAAAGCAG AGTGACCATCAGCGTGGACACCAGCAAGAACCAGTTCAG CCTGAAGCTGAGCAGCGTGACAGCCGCCGACACCGCCGT GTACTACTGCGCCAGAGACTACGGCCCTGGCAACTACGA CTGGTACTTCGACCTGTGGGGCAGAGGCACCCTGGTGAC AGTGTCCAGCGCTAGCACCAAGGGCCCATCGGTCTTCCCC CTGGCACCCTCCTCCAAGAGCACCTCTGGGGGCACAGCG GCCCTGGGCTGCCTGGTCAAGGACTACTTCCCCGAACCGG TGACGGTGTCGTGGAACTCAGGCGCCCTGACCAGCGGCG TGCACACCTTCCCGGCTGTCCTACAGTCCTCAGGACTCTA CTCCCTCAGCAGCGTGGTGACCGTGCCCTCCAGCAGCTTG GGCACCCAGACCTACATCTGCAACGTGAATCACAAGCCC AGCAACACCAAGGTGGACAAGAAAGTTGAGCCCAAATCT TGTGACAAAACTCACACATGCCCACCGTGCCCAGCACCTG AAGCTGCAGGGGGACCGTCAGTCTTCCTCTTCCCCCCAAA ACCCAAGGACACCCTCATGATCTCCCGGACCCCTGAGGTC ACATGCGTGGTGGTGGACGTGAGCCACGAAGACCCTGAG GTCAAGTTCAACTGGTACGTGGACGGCGTGGAGGTGCAT AATGCCAAGACAAAGCCGCGGGAGGAGCAGTACAACAG CACGTACCGTGTGGTCAGCGTCCTCACCGTCCTGCACCAG GACTGGCTGAATGGCAAGGAGTACAAGTGCAAGGTCTCC AACAAAGCCCTCGGCGCCCCCATCGAGAAAACCATCTCC AAAGCCAAAGGGCAGCCCCGAGAACCACAGGTGTACACC CTGCCCCCCTGCAGAGATGAGCTGACCAAGAACCAGGTG TCCCTGTGGTGTCTGGTCAAGGGCTTCTACCCCAGCGATA TCGCCGTGGAGTGGGAGAGCAACGGCCAGCCTGAGAACA ACTACAAGACCACCCCCCCTGTGCTGGACAGCGACGGCA GCTTCTTCCTGTACTCCAAACTGACCGTGGACAAGAGCCG GTGGCAGCAGGGCAACGTGTTCAGCTGCAGCGTGATGCA CGAGGCCCTGCACAACCACTACACCCAGAAGTCCCTGAG CCTGAGCCCCGGCGAGGCGGCGGAAGCGGAGGAGGAG GATCTGGGGGCGGAGGTTCCGGAGGCGGTGGATCTCAGG CCGTGCTGACACAGCCTGCCAGCCTGTCTGCTTCTCCTGG CGCCTCTGCCTCCCTGACCTGCACACTGAGAAGAGGCATC AACGTGGGCGCCTACAGCATCTACTGGTATCAGCAGAAG CCCGGCAGCCCCCCTCAGTACCTGCTGAGATACAAGAGC |

TABLE 43 -continued

Sequences of bispecific, tetravalent anti-4-1BB/monovalent anti-CEA (A5B7) human IgG1 P329GLALA antigen binding molecules (Constructs with a-CEA VH fused to Fc hole chain and VL fused to Fc knob chain, termed hole-VH)

| SEQ ID NO: | Description | Sequence |
|---|---|---|
|  |  | GACAGCGACAAGCAGCAGGGCAGCGGCGTGTCCAGCAGA<br>TTCAGCGCCAGCAAGGACGCCTCTGCCAACGCCGGAATC<br>CTGCTGATCAGCGGCCTGCAGTCTGAGGACGAGGCCGAC<br>TACTACTGCATGATCTGGCACTCTGGCGCCAGCGCCGTGT<br>TTGGCGGAGGCACAAAACTGACCGTGCTG |
| 43 | VLCL-Light chain (20H4.9) (nucleotide sequence) | see Table 1 |
| 93 | VHCH1-VHCH1 (20H4.9)-Heavy chain hole-VH (A5B7) | QVQLQQWGAGLLKPSETLSLTCAVYGGSFSGYYWSWIRQS<br>PEKGLEWIGEINHGGYVTYNPSLESRVTISVDTSKNQFSLKLS<br>SVTAADTAVYYCARDYGPGNYDWYFDLWGRGTLVTVSSA<br>STKGPSVFPLAPSSKSTSGGTAALGCLVKDYFPEPVTVSWNS<br>GALTSGVHTFPAVLQSSGLYSLSSVVTVPSSSLGTQTYICNV<br>NHKPSNTKVDKKVEPKSCDGGGGSGGGGSQVQLQQWGAG<br>LLKPSETLSLTCAVYGGSFSGYYWSWIRQSPEKGLEWIGEIN<br>HGGYVTYNPSLESRVTISVDTSKNQFSLKLSSVTAADTAVY<br>YCARDYGPGNYDWYFDLWGRGTLVTVSSASTKGPSVFPLA<br>PSSKSTSGGTAALGCLVKDYFPEPVTVSWNSGALTSGVHTFP<br>AVLQSSGLYSLSSVVTVPSSSLGTQTYICNVNHKPSNTKVDK<br>KVEPKSCDKTHTCPPCPAPEAAGGPSVFLFPPKPKDTLMISR<br>TPEVTCVVVDVSHEDPEVKFNWYVDGVEVHNAKTKPREEQ<br>YNSTYRVVSVLTVLHQDWLNGKEYKCKVSNKALGAPIEKTI<br>SKAKGQPREPQVCTLPPSRDELTKNQVSLSCAVKGFYPSDIA<br>VEWESNGQPENNYKTTPPVLDSDGSFFLVSKLTVDKSRWQQ<br>GNVFSCSVMHEALHNHYTQKSLSLSPGGGGGSGGGGSGGG<br>GSGGGGSEVQLVESGGGLVQPGRSLRLSCAASGFTVSSYW<br>MHWVRQAPGKGLEWVGFIRNKANGGTTEYAASVKGRFTIS<br>RDDSKNTLYLQMNSLRAEDTAVYYCARDRGLRFYFDYWG<br>QGTTVTVSS |
| 94 | VHCH1-VHCH1 (20H4.9)-Heavy chain knob-VL (A5B7) | QVQLQQWGAGLLKPSETLSLTCAVYGGSFSGYYWSWIRQS<br>PEKGLEWIGEINHGGYVTYNPSLESRVTISVDTSKNQFSLKLS<br>SVTAADTAVYYCARDYGPGNYDWYFDLWGRGTLVTVSSA<br>STKGPSVFPLAPSSKSTSGGTAALGCLVKDYFPEPVTVSWNS<br>GALTSGVHTFPAVLQSSGLYSLSSVVTVPSSSLGTQTYICNV<br>NHKPSNTKVDKKVEPKSCDGGGGSGGGGSQVQLQQWGAG<br>LLKPSETLSLTCAVYGGSFSGYYWSWIRQSPEKGLEWIGEIN<br>HGGYVTYNPSLESRVTISVDTSKNQFSLKLSSVTAADTAVY<br>YCARDYGPGNYDWYFDLWGRGTLVTVSSASTKGPSVFPLA<br>PSSKSTSGGTAALGCLVKDYFPEPVTVSWNSGALTSGVHTFP<br>AVLQSSGLYSLSSVVTVPSSSLGTQTYICNVNHKPSNTKVDK<br>KVEPKSCDKTHTCPPCPAPEAAGGPSVFLFPPKPKDTLMISR<br>TPEVTCVVVDVSHEDPEVKFNWYVDGVEVHNAKTKPREEQ<br>YNSTYRVVSVLTVLHQDWLNGKEYKCKVSNKALGAPIEKTI<br>SKAKGQPREPQVYTLPPCRDELTKNQVSLWCLVKGFYPSDI<br>AVEWESNGQPENNYKTTPPVLDSDGSFFLYSKLTVDKSRWQ<br>QGNVFSCSVMHEALHNHYTQKSLSLSPGGGGGSGGGGSGG<br>GGSGGGGSQAVLTQPASLSASPGASASLTCTLRRGINVGAYS<br>IYWYQQKPGSPPQYLLRYKSDSDKQQGSGVSSRFSASKDAS<br>ANAGILLISGLQSEDEADYYCMIWHSGASAVFGGGTKLTVL |
| 46 | VLCL-Light chain (20H4.9) | see Table 1 |

The base pair and amino acid sequences for 4+1 anti-4-1BB, anti-CEA (A5B7P) constructs with a-CEA VH fused to the Fc knob heavy chain and VL fused to Fc hole heavy chain can be found respectively in Table 44. The base pair and amino acid sequences for 4+1 anti-4-1BB, anti-CEA (A5B7P) constructs with a-CEA VL fused to Fc knob heavy chain and VH fused to Fc hole heavy chain can be found respectively in Table 45.

TABLE 44

Sequences of bispecific, tetravalent anti-4-1BB/ monovalent anti-CEA (A5B7P) human IgG1 P329GLALA antigen binding molecules (Constructs with a-CEA VL fused to Fc hole chain and VH fused to Fc knob chain, termed hole-VL)

| SEQ ID NO: | Description | Sequence |
|---|---|---|
| 203 | VHCH1-VHCH1 (20H4.9)-Heavy chain hole-VL (A5B7P) | QVQLQQWGAGLLKPSETLSLTCAVYGGSFSGYYWSW IRQSPEKGLEWIGEINHGGYVTYNPSLESRVTISVD TSKNQFSLKLSSVTAADTAVYYCARDYGPGNYDWYF DLWGRGTLVTVSSASTKGPSVFPLAPSSKSTSGGTA ALGCLVKDYFPEPVTVSWNSGALTSGVHTFPAVLQS SGLYSLSSVVTVPSSSLGTQTYICNVNHKPSNTKVD KKVEPKSCDGGGSGGGGSQVQLQQWGAGLLKPSET LSLTCAVYGGSFSGYYWSWIRQSPEKGLEWIGEINH GGYVTYNPSLESRVTISVDTSKNQFSLKLSSVTAAD TAVYYCARDYGPGNYDWYFDLWGRGTLVTVSSASTK GPSVFPLAPSSKSTSGGTAALGCLVKDYFPEPVTVS WNSGALTSGVHTFPAVLQSSGLYSLSSVVTVPSSSL GTQTYICNVNHKPSNTKVDKKVEPKSCDKTHTCPPC PAPEAAGGPSVFLFPPKPKDTLMISRTPEVTCVVVD VSHEDPEVKFNWYVDGVEVHNAKTKPREEQYNSTYR VVSVLTVLHQDWLNGKEYKCKVSNKALGAPIEKTIS KAKGQPREPQVCTLPPSRDELTKNQVSLSCAVKGFY PSDIAVEWESNGQPENNYKTTPPVLDSDGSFFLVSK LTVDKSRWQQGNVFSCSVMHEALHNHYTQKSLSLSP GGGGSGGGGSGGGGSGGGGSQTVLSQSPAILSASP GEKVTMTCRASSSVTYIHWYQQKPGSSPKSWIYATS NLASGVPARFSGSGSGTSYSLTISRVEAEDAATYYC QHWSSKPPTFGGGTKLEIK |
| 204 | VHCH1-VHCH1 (20H4.9)-Heavy chain knob-VH (A5B7P) | QVQLQQWGAGLLKPSETLSLTCAVYGGSFSGYYWSW IRQSPEKGLEWIGEINHGGYVTYNPSLESRVTISVD TSKNQFSLKLSSVTAADTAVYYCARDYGPGNYDWYF DLWGRGTLVTVSSASTKGPSVFPLAPSSKSTSGGTA ALGCLVKDYFPEPVTVSWNSGALTSGVHTFPAVLQS SGLYSLSSVVTVPSSSLGTQTYICNVNHKPSNTKVD KKVEPKSCDGGGSGGGGSQVQLQQWGAGLLKPSET LSLTCAVYGGSFSGYYWSWIRQSPEKGLEWIGEINH GGYVTYNPSLESRVTISVDTSKNQFSLKLSSVTAAD TAVYYCARDYGPGNYDWYFDLWGRGTLVTVSSASTK GPSVFPLAPSSKSTSGGTAALGCLVKDYFPEPVTVS WNSGALTSGVHTFPAVLQSSGLYSLSSVVTVPSSSL GTQTYICNVNHKPSNTKVDKKVEPKSCDKTHTCPPC PAPEAAGGPSVFLFPPKPKDTLMISRTPEVTCVVVD VSHEDPEVKFNWYVDGVEVHNAKTKPREEQYNSTYR VVSVLTVLHQDWLNGKEYKCKVSNKALGAPIEKTIS KAKGQPREPQVYTLPPCRDELTKNQVSLWCLVKGFY PSDIAVEWESNGQPENNYKTTPPVLDSDGSFFLYSK LTVDKSRWQQGNVFSCSVMHEALHNHYTQKSLSLSP GGGGSGGGGSGGGGSGGGGSEVKLVESGGGLVQPG GSLRLSCATSGFTFTDYYMNWVRQPPGKALEWLGFI GNKANGYTTEYSASVKGRFTISRDKSQSILYLQMNT LRAEDSATYYCTRDRGLRFYFDYWGQGTTLTVSS |
| 46 | VLCL-Light chain (20H4.9) | see Table 1 |

TABLE 45

Sequences of bispecific, tetravalent anti-4-1BB/ monovalent anti-CEA (A5B7P) human IgG1 P329GLALA antigen binding molecules (Constructs with a-CEA VH fused to Fc hole chain and VL fused to Fc knob chain, termed hole-VH)

| SEQ ID NO: | Description | Sequence |
|---|---|---|
| 205 | VHCH1-VHCH1 (20H4.9)-Heavy chain hole-VH (A5B7P) | QVQLQQWGAGLLKPSETLSLTCAVYGGSFSGYYWSW IRQSPEKGLEWIGEINHGGYVTYNPSLESRVTISVD TSKNQFSLKLSSVTAADTAVYYCARDYGPGNYDWYF DLWGRGTLVTVSSASTKGPSVFPLAPSSKSTSGGTA ALGCLVKDYFPEPVTVSWNSGALTSGVHTFPAVLQS SGLYSLSSVVTVPSSSLGTQTYICNVNHKPSNTKVD KKVEPKSCDGGGSGGGGSQVQLQQWGAGLLKPSET LSLTCAVYGGSFSGYYWSWIRQSPEKGLEWIGEINH GGYVTYNPSLESRVTISVDTSKNQFSLKLSSVTAAD TAVYYCARDYGPGNYDWYFDLWGRGTLVTVSSASTK GPSVFPLAPSSKSTSGGTAALGCLVKDYFPEPVTVS WNSGALTSGVHTFPAVLQSSGLYSLSSVVTVPSSSL GTQTYICNVNHKPSNTKVDKKVEPKSCDKTHTCPPC PAPEAAGGPSVFLFPPKPKDTLMISRTPEVTCVVVD VSHEDPEVKFNWYVDGVEVHNAKTKPREEQYNSTYR VVSVLTVLHQDWLNGKEYKCKVSNKALGAPIEKTIS KAKGQPREPQVCTLPPSRDELTKNQVSLSCAVKGFY PSDIAVEWESNGQPENNYKTTPPVLDSDGSFFLVSK LTVDKSRWQQGNVFSCSVMHEALHNHYTQKSLSLSP GGGGSGGGGSGGGGSGGGGSEVKLVESGGGLVQPG GSLRLSCATSGFTFTDYYMNWVRQPPGKALEWLGFI GNKANGYTTEYSASVKGRFTISRDKSQSILYLQMNT LRAEDSATYYCTRDRGLRFYFDYWGQGTTLTVSS |
| 206 | VHCH1-VHCH1 (20H4.9)-Heavy chain knob-VL (A5B7P) | QVQLQQWGAGLLKPSETLSLTCAVYGGSFSGYYWSW IRQSPEKGLEWIGEINHGGYVTYNPSLESRVTISVD TSKNQFSLKLSSVTAADTAVYYCARDYGPGNYDWYF DLWGRGTLVTVSSASTKGPSVFPLAPSSKSTSGGTA ALGCLVKDYFPEPVTVSWNSGALTSGVHTFPAVLQS SGLYSLSSVVTVPSSSLGTQTYICNVNHKPSNTKVD KKVEPKSCDGGGSGGGGSQVQLQQWGAGLLKPSET LSLTCAVYGGSFSGYYWSWIRQSPEKGLEWIGEINH GGYVTYNPSLESRVTISVDTSKNQFSLKLSSVTAAD TAVYYCARDYGPGNYDWYFDLWGRGTLVTVSSASTK GPSVFPLAPSSKSTSGGTAALGCLVKDYFPEPVTVS WNSGALTSGVHTFPAVLQSSGLYSLSSVVTVPSSSL GTQTYICNVNHKPSNTKVDKKVEPKSCDKTHTCPPC PAPEAAGGPSVFLFPPKPKDTLMISRTPEVTCVVVD VSHEDPEVKFNWYVDGVEVHNAKTKPREEQYNSTYR VVSVLTVLHQDWLNGKEYKCKVSNKALGAPIEKTIS KAKGQPREPQVYTLPPCRDELTKNQVSLWCLVKGFY PSDIAVEWESNGQPENNYKTTPPVLDSDGSFFLYSK LTVDKSRWQQGNVFSCSVMHEALHNHYTQKSLSLSP GGGGSGGGGSGGGGSGGGGSQTVLSQSPAILSASP GEKVTMTCRASSSVTYIHWYQQKPGSSPKSWIYATS NLASGVPARFSGSGSGTSYSLTISRVEAEDAATYYC QHWSSKPPTFGGGTKLEIK |
| 46 | VLCL-Light chain (20H4.9) | see Table 1 |

The base pair and amino acid sequences for 4+1 anti-4-1BB, anti-CEA (431/26) constructs with a-CEA VH fused to the Fc knob heavy chain and VL fused to Fc hole heavy chain can be found respectively in Table 46. The base pair and amino acid sequences for 4+1 anti-4-1BB, anti-CEA (431/26) constructs with a-CEA VL fused to Fc knob heavy chain and VH fused to Fc hole heavy chain can be found respectively in Table 47.

TABLE 46

Sequences of bispecific, tetravalent anti-4-1BB/monovalent anti-CEA (431/26) human IgG1 P329GLALA antigen binding molecules (Constructs with a-CEA VL fused to Fc hole chain and VH fused to Fc knob chain, termed hole-VL)

| SEQ ID NO: | Description | Sequence |
|---|---|---|
| 207 | VHCH1-VHCH1 (20H4.9)-Heavy chain hole-VL (431/26) | QVQLQQWGAGLLKPSETLSLTCAVYGGSFSGYYWSW IRQSPEKGLEWIGEINHGGYVTYNPSLESRVTISVD TSKNQFSLKLSSVTAADTAVYYCARDYGPGNYDWYF DLWGRGTLVTVSSASTKGPSVFPLAPSSKSTSGGTA ALGCLVKDYFPEPVTVSWNSGALTSGVHTFPAVLQS SGLYSLSSVVTVPSSSLGTQTYICNVNHKPSNTKVD KKVEPKSCDGGGSGGGGSQVQLQQWGAGLLKPSET LSLTCAVYGGSFSGYYWSWIRQSPEKGLEWIGEINH GGYVTYNPSLESRVTISVDTSKNQFSLKLSSVTAAD TAVYYCARDYGPGNYDWYFDLWGRGTLVTVSSASTK GPSVFPLAPSSKSTSGGTAALGCLVKDYFPEPVTVS WNSGALTSGVHTFPAVLQSSGLYSLSSVVTVPSSSL GTQTYICNVNHKPSNTKVDKKVEPKSCDKTHTCPPC PAPEAAGGPSVFLFPPKPKDTLMISRTPEVTCVVVD VSHEDPEVKFNWYVDGVEVHNAKTKPREEQYNSTYR VVSVLTVLHQDWLNGKEYKCKVSNKALGAPIEKTIS KAKGQPREPQVCTLPPSRDELTKNQVSLSCAVKGFY PSDIAVEWESNGQPENNYKTTPPVLDSDGSFFLVSK LTVDKSRWQQGNVFSCSVMHEALHNHYTQKSLSLSP GGGGSGGGGSGGGGSGGGGSDIQMTQSPSSLSASV GDRVTITCSTSSSVSYMHWYQQKPGKAPKLLIYSTS NLASGVPSRFSGSGSGTDFTFTISSLQPEDIATYYC HQWSSYPTFGQGTKVEIK |
| 208 | VHCH1-VHCH1 (20H4.9)-Heavy chain knob-VL (431/26) | QVQLQQWGAGLLKPSETLSLTCAVYGGSFSGYYWSW IRQSPEKGLEWIGEINHGGYVTYNPSLESRVTISVD TSKNQFSLKLSSVTAADTAVYYCARDYGPGNYDWYF DLWGRGTLVTVSSASTKGPSVFPLAPSSKSTSGGTA ALGCLVKDYFPEPVTVSWNSGALTSGVHTFPAVLQS SGLYSLSSVVTVPSSSLGTQTYICNVNHKPSNTKVD KKVEPKSCDGGGSGGGGSQVQLQQWGAGLLKPSET LSLTCAVYGGSFSGYYWSWIRQSPEKGLEWIGEINH GGYVTYNPSLESRVTISVDTSKNQFSLKLSSVTAAD TAVYYCARDYGPGNYDWYFDLWGRGTLVTVSSASTK GPSVFPLAPSSKSTSGGTAALGCLVKDYFPEPVTVS WNSGALTSGVHTFPAVLQSSGLYSLSSVVTVPSSSL GTQTYICNVNHKPSNTKVDKKVEPKSCDKTHTCPPC PAPEAAGGPSVFLFPPKPKDTLMISRTPEVTCVVVD VSHEDPEVKFNWYVDGVEVHNAKTKPREEQYNSTYR VVSVLTVLHQDWLNGKEYKCKVSNKALGAPIEKTIS KAKGQPREPQVYTLPPCRDELTKNQVSLWCLVKGFY PSDIAVEWESNGQPENNYKTTPPVLDSDGSFFLYSK LTVDKSRWQQGNVFSCSVMHEALHNHYTQKSLSLSP GGGGSGGGGSGGGGSGGGGSQVQLQESGPGLVRPS QTLSLTCTVSGFTISSGYSWHWVRQPPGRGLEWIGY IQYSGITNYNPSLKSRVTMLVDTSKNQFSLRLSSVT AADTAVYYCAREDYDYHWYFDVWGQGSLVTVSS |
| 46 | VLCL-Light chain (20H4.9) | see Table 1 |

TABLE 47

Sequences of bispecific, tetravalent anti-4-1BB/monovalent anti-CEA (431/26) human IgG1 P329GLALA antigen binding molecules (Constructs with a-CEA VH fused to Fc hole chain and VL fused to Fc knob chain, termed hole-VH)

| SEQ ID NO: | Description | Sequence |
|---|---|---|
| 209 | VHCH1-VHCH1 (20H4.9)-Heavy chain hole-VH (431/26) | QVQLQQWGAGLLKPSETLSLTCAVYGGSFSGYYWSW IRQSPEKGLEWIGEINHGGYVTYNPSLESRVTISVD TSKNQFSLKLSSVTAADTAVYYCARDYGPGNYDWYF DLWGRGTLVTVSSASTKGPSVFPLAPSSKSTSGGTA ALGCLVKDYFPEPVTVSWNSGALTSGVHTFPAVLQS SGLYSLSSVVTVPSSSLGTQTYICNVNHKPSNTKVD KKVEPKSCDGGGSGGGGSQVQLQQWGAGLLKPSET LSLTCAVYGGSFSGYYWSWIRQSPEKGLEWIGEINH GGYVTYNPSLESRVTISVDTSKNQFSLKLSSVTAAD TAVYYCARDYGPGNYDWYFDLWGRGTLVTVSSASTK GPSVFPLAPSSKSTSGGTAALGCLVKDYFPEPVTVS WNSGALTSGVHTFPAVLQSSGLYSLSSVVTVPSSSL GTQTYICNVNHKPSNTKVDKKVEPKSCDKTHTCPPC PAPEAAGGPSVFLFPPKPKDTLMISRTPEVTCVVVD VSHEDPEVKFNWYVDGVEVHNAKTKPREEQYNSTYR VVSVLTVLHQDWLNGKEYKCKVSNKALGAPIEKTIS KAKGQPREPQVCTLPPSRDELTKNQVSLSCAVKGFY PSDIAVEWESNGQPENNYKTTPPVLDSDGSFFLVSK LTVDKSRWQGGNVFSCSVMHEALHNHYTQKSLSLSP GGGGSGGGGSGGGGSGGGGSQVQLQESGPGLVRPS QTLSLTCTVSGFTISSGYSWHWVRQPPGRGLEWIGY IQYSGITNYNPSLKSRVTMLVDTSKNQFSLRLSSVT AADTAVYYCAREDYDYHWYFDVWGQGSLVTVSS |
| 210 | VHCH1-VHCH1 (20H4.9)-Heavy chain knob-VL (431/26) | QVQLQQWGAGLLKPSETLSLTCAVYGGSFSGYYWSW IRQSPEKGLEWIGEINHGGYVTYNPSLESRVTISVD TSKNQFSLKLSSVTAADTAVYYCARDYGPGNYDWYF DLWGRGTLVTVSSASTKGPSVFPLAPSSKSTSGGTA ALGCLVKDYFPEPVTVSWNSGALTSGVHTFPAVLQS SGLYSLSSVVTVPSSSLGTQTYICNVNHKPSNTKVD KKVEPKSCDGGGSGGGGSQVQLQQWGAGLLKPSET LSLTCAVYGGSFSGYYWSWIRQSPEKGLEWIGEINH GGYVTYNPSLESRVTISVDTSKNQFSLKLSSVTAAD TAVYYCARDYGPGNYDWYFDLWGRGTLVTVSSASTK GPSVFPLAPSSKSTSGGTAALGCLVKDYFPEPVTVS WNSGALTSGVHTFPAVLQSSGLYSLSSVVTVPSSSL GTQTYICNVNHKPSNTKVDKKVEPKSCDKTHTCPPC PAPEAAGGPSVFLFPPKPKDTLMISRTPEVTCVVVD VSHEDPEVKFNWYVDGVEVHNAKTKPREEQYNSTYR VVSVLTVLHQDWLNGKEYKCKVSNKALGAPIEKTIS KAKGQPREPQVYTLPPCRDELTKNQVSLWCLVKGFY PSDIAVEWESNGQPENNYKTTPPVLDSDGSFFLYSK LTVDKSRWQQGNVFSCSVMHEALHNHYTQKSLSLSP GGGGSGGGGSGGGGSGGGGSDIQMTQSPSSLSASV GDRVTITCSTSSSVSYMHWYQQKPGKAPKLLIYSTS NLASGVPSRFSGSGSGTDFTFTISSLQPEDIATYYC HQWSSYPTFGQGTKVEIK |
| 46 | VLCL-Light chain (20H4.9) | see Table 1 |

Example 8

Preparation, Purification and Characterization of Bispecific Antigen Binding Molecules with Bivalent Binding to 4-1BB and Monovalent Binding to CD19

8.1 Generation of Bispecific Antibodies with a Bivalent Binding to 4-1BB and a Monovalent Binding to CD19

Bispecific agonistic 4-1BB antibodies with bivalent binding for 4-1BB and monovalent binding for CD19, also termed 2+1, were prepared as depicted in FIGS. 1A and 1B. The knobs into hole technology was applied by introducing the S354C/T366W mutations in the first heavy chain HC1 (Fc knob heavy chain) and introducing the Y349C/T366S/L368A/Y407V mutations in the second heavy chain HC2 (Fc hole heavy chain) to allow generation of a heterodimer.

In this example, the first heavy chain HC1 of the construct was comprised of the following components: VHCH1 of anti-4-1BB binder (clone 20H4.9), followed by Fc hole, at which C-terminus a VL or VH of anti-CD19 binder (clone 2B11 or 8B8-018) was fused. The second heavy chain HC2 was comprised of VHCH1 of anti-4-1BB followed by Fc knob, at which C-terminus a VH or VL, respectively, of anti-CD19 binder (clone 2B11 or 8B8-018) was fused. The generation and preparation of the CD19 binders clone 2B11 or 8B8-018 is described in WO 2016/075278 A2, which is incorporated herein by reference. For the 4-1BB binder, the VH and VL sequences of clone 20H4.9 were obtained in accordance with U.S. Pat. No. 7,288,638 B2 or U.S. Pat. No. 7,659,384 B2. Combination of the two heavy chains allows generation of a heterodimer, which includes a CD19 binding moiety and two 4-1BB binding Fabs (FIGS. 1A and 1B).

The Pro329Gly, Leu234Ala and Leu235Ala mutations have been introduced in the constant region of the knob and hole heavy chains to abrogate binding to Fc gamma receptors according to the method described in International Patent Appl. Publ. No. WO2012/130831A1.

The amino acid sequences for 2+1 anti-4-1BB, anti-CD19 constructs with a-CD19 (2B11) VH fused to knob and VL fused to hole chain can be found respectively in Table 48. The amino acid sequences for 2+1 anti-4-1BB, anti-CD19 (2B11) constructs with a-CD19 VL fused to knob and VH fused to hole chain can be found in Table 49, respectively.

TABLE 48

Sequences of bispecific, bivalent anti-4-1BB/ monovalent anti-CD19 (2B11) human IgG1 P329GLALA antigen binding molecules (Constructs with a-CD19 VL fused to Fc hole chain and VH fused to Fc knob chain, also termed hole-VL)

| SEQ ID NO: | Description | Sequence |
|---|---|---|
| 139 | VHCH1 (20H4.9)- Heavy chain hole-VL (2B11) | QVQLQQWGAGLLKPSETLSLTCAVYGGSFSGYYWSW IRQSPEKGLEWIGEINHGGYVTYNPSLESRVTISVD TSKNQFSLKLSSVTAADTAVYYCARDYGPGNYDWYF DLWGRGTLVTVSSASTKGPSVFPLAPSSKSTSGGTA ALGCLVKDYFPEPVTVSWNSGALTSGVHTFPAVLQS SGLYSLSSVVTVPSSSLGTQTYICNVNHKPSNTKVD KKVEPKSCDKTHTCPPCPAPEAAGGPSVFLFPPKPK DTLMISRTPEVTCVVVDVSHEDPEVKFNWYVDGVEV HNAKTKPREEQYNSTYRVVSVLTVLHQDWLNGKEYK CKVSNKALGAPIEKTISKAKGQPREPQVCTLPPSRD ELTKNQVSLSCAVKGFYPSDIAVEWESNGQPENNYK TTPPVLDSDGSFFLVSKLTVDKSRWQQGNVFSCSVM HEALHNHYTQKSLSLSPGGGGSGGGGSGGGGSGGG GSDIVMTQTPLSLSVTPGQPASISCKSSQSLETSTG TTYLNWYLQKPGQSPQLLIYRVSKRFSGVPDRFSGS GSGTDFTLKISRVEAEDVGVYYCLQLLEDPYTFGQG TKLEIK |
| 140 | VHCH1 (20H4.9)- Heavy chain knob-VH (2B11) | QVQLQQWGAGLLKPSETLSLTCAVYGGSFSGYYWSW IRQSPEKGLEWIGEINHGGYVTYNPSLESRVTISVD TSKNQFSLKLSSVTAADTAVYYCARDYGPGNYDWYF DLWGRGTLVTVSSASTKGPSVFPLAPSSKSTSGGTA ALGCLVKDYFPEPVTVSWNSGALTSGVHTFPAVLQS KKVEPKSCDKTHTCPPCPAPEAAGGPSVFLFPSGLY SLSSVVTVPSSSLGTQTYICNVNHKPSNTKVDPKPK DTLMISRTPEVTCVVVDVSHEDPEVKFNWYVDGVEV HNAKTKPREEQYNSTYRVVSVLTVLHQDWLNGKEYK CKVSNKALGAPIEKTISKAKGQPREPQVYTLPPCRD ELTKNQVSLWCLVKGFYPSDIAVEWESNGQPENNYK TTPPVLDSDGSFFLYSKLTVDKSRWQQGNVFSCSVM |

TABLE 48-continued

Sequences of bispecific, bivalent anti-4-1BB/ monovalent anti-CD19 (2B11) human IgG1 P329GLALA antigen binding molecules (Constructs with a-CD19 VL fused to Fc hole chain and VH fused to Fc knob chain, also termed hole-VL)

| SEQ ID NO: | Description | Sequence |
|---|---|---|
| | | HEALHNHYTQKSLSLSPGGGGSGGGGSGGGGSGGG GSQVQLVQSGAEVKKPGASVKVSCKASGYTFTDYIM HWVRQAPGQGLEWMGYINPYNDGSKYTEKFQGRVTM TSDTSISTAYMELSRLRSDDTAVYYCARGTYYYGPQ LFDYWGQGTTVTVSS |
| 46 | VLCL-Light chain (20H4.9) | see Table 1 |

TABLE 49

Sequences of bispecific, bivalent anti-4-1BB/ monovalent anti-CD19 (2B11) human IgG1 P329GLALA antigen binding molecules (Constructs with a-CD19 VH fused to Fc hole chain and VL fused to Fc knob chain, termed hole-VH)

| SEQ ID NO: | Description | Sequence |
|---|---|---|
| 141 | VHCH1 (20H4.9)- Heavy chain hole-VH (2B11) | QVQLQQWGAGLLKPSETLSLTCAVYGGSFSGYYWSW IRQSPEKGLEWIGEINHGGYVTYNPSLESRVTISVD TSKNQFSLKLSSVTAADTAVYYCARDYGPGNYDWYF DLWGRGTLVTVSSASTKGPSVFPLAPSSKSTSGGTA ALGCLVKDYFPEPVTVSWNSGALTSGVHTFPAVLQS SGLYSLSSVVTVPSSSLGTQTYICNVNHKPSNTKVD KKVEPKSCDKTHTCPPCPAPEAAGGPSVFLFPPKPK DTLMISRTPEVTCVVVDVSHEDPEVKFNWYVDGVEV HNAKTKPREEQYNSTYRVVSVLTVLHQDWLNGKEYK CKVSNKALGAPIEKTISKAKGQPREPQVCTLPPSRD ELTKNQVSLSCAVKGFYPSDIAVEWESNGQPENNYK TTPPVLDSDGSFFLVSKLTVDKSRWQQGNVFSCSVM HEALHNHYTQKSLSLSPGGGGSGGGGSGGGGSGGG GSQVQLVQSGAEVKKPGASVKVSCKASGYTFTDYIM HWVRQAPGQGLEWMGYINPYNDGSKYTEKFQGRVTM TSDTSISTAYMELSRLRSDDTAVYYCARGTYYYGPQ LFDYWGQGTTVTVSS |
| 142 | VHCH1 (20H4.9)- Heavy chain knob-VL (2B11) | QVQLQQWGAGLLKPSETLSLTCAVYGGSFSGYYWSW IRQSPEKGLEWIGEINHGGYVTYNPSLESRVTISVD TSKNQFSLKLSSVTAADTAVYYCARDYGPGNYDWYF DLWGRGTLVTVSSASTKGPSVFPLAPSSKSTSGGTA ALGCLVKDYFPEPVTVSWNSGALTSGVHTFPAVLQS SGLYSLSSVVTVPSSSLGTQTYICNVNHKPSNTKVD KKVEPKSCDKTHTCPPCPAPEAAGGPSVFLFPPKPK DTLMISRTPEVTCVVVDVSHEDPEVKFNWYVDGVEV HNAKTKPREEQYNSTYRVVSVLTVLHQDWLNGKEYK CKVSNKALGAPIEKTISKAKGQPREPQVYTLPPCRD ELTKNQVSLWCLVKGFYPSDIAVEWESNGQPENNYK TTPPVLDSDGSFFLYSKLTVDKSRWQQGNVFSCSVM HEALHNHYTQKSLSLSPGGGGSGGGGSGGGGSGGG GSDIVMTQTPLSLSVTPGQPASISCKSSQSLETSTG TTYLNWYLQKPGQSPQLLIYRVSKRFSGVPDRFSGS GSGTDFTLKISRVEAEDVGVYYCLQLLEDPYTFGQG TKLEIK |
| 46 | VLCL-Light chain (20H4.9) | see Table 1 |

The amino acid sequences for 2+1 anti-4-1BB, anti-CD19 constructs with a-CD19 (8B8-018) VH fused to knob and VL fused to hole chain can be found respectively in Table 50. The amino acid sequences for 2+1 anti-4-1BB, anti-CD19 (8B8-018) constructs with a-CD19 VL fused to knob and VH fused to hole chain can be found in Table 51, respectively.

TABLE 50

Sequences of bispecific, bivalent anti-4-1BB/ monovalent anti-CD19 (8B8-018) human IgG1 P329GLALAantigen binding molecules (Constructs with a-CD19 VL fused to Fc hole chain and VH fused to Fc knob chain, also termed hole-VL)

| SEQ ID NO: | Description | Sequence |
|---|---|---|
| 143 | VHCH1 (20H4.9)- Heavy chain hole-VL (8B8-018) | QVQLQQWGAGLLKPSETLSLTCAVYGGSFSGYYWSW IRQSPEKGLEWIGEINHGGYVTYNPSLESRVTISVD TSKNQFSLKLSSVTAADTAVYYCARDYGPGNYDWYF DLWGRGTLVTVSSASTKGPSVFPLAPSSKSTSGGTA ALGCLVKDYFPEPVTVSWNSGALTSGVHTFPAVLQS SGLYSLSSVVTVPSSSLGTQTYICNVNHKPSNTKVD KKVEPKSCDKTHTCPPCPAPEAAGGPSVFLFPPKPK DTLMISRTPEVTCVVVDVSHEDPEVKFNWYVDGVEV HNAKTKPREEQYNSTYRVVSVLTVLHQDWLNGKEYK CKVSNKALGAPIEKTISKAKGQPREPQVCTLPPSRD ELTKNQVSLSCAVKGFYPSDIAVEWESNGQPENNYK TTPPVLDSDGSFFLVSKLTVDKSRWQQGNVFSCSVM HEALHNHYTQKSLSLSPGGGGSGGGGSGGGGSGGG GSDIVMTQTPLSLSVTPGQPASISCKSSQSLENPNG NTYLNWYLQKPGQSPQLLIYRVSKRFSGVPDRFSGS GSGTDFTLKISRVEAEDVGVYYCLQLTHVPYTFGQG TKLEIK |
| 144 | VHCH1 (20H4.9)- Heavy chain knob-VH (8B8-018) | QVQLQQWGAGLLKPSETLSLTCAVYGGSFSGYYWSW IRQSPEKGLEWIGEINHGGYVTYNPSLESRVTISVD TSKNQFSLKLSSVTAADTAVYYCARDYGPGNYDWYF DLWGRGTLVTVSSASTKGPSVFPLAPSSKSTSGGTA ALGCLVKDYFPEPVTVSWNSGALTSGVHTFPAVLQS SGLYSLSSVVTVPSSSLGTQTYICNVNHKPSNTKVD KKVEPKSCDKTHTCPPCPAPEAAGGPSVFLFPPKPK DTLMISRTPEVTCVVVDVSHEDPEVKFNWYVDGVEV HNAKTKPREEQYNSTYRVVSVLTVLHQDWLNGKEYK CKVSNKALGAPIEKTISKAKGQPREPQVYTLPPCRD ELTKNQVSLWCLVKGFYPSDIAVEWESNGQPENNYK TTPPVLDSDGSFFLYSKLTVDKSRWQQGNVFSCSVM HEALHNHYTQKSLSLSPGGGGSGGGGSGGGGSGGG GSQVQLVQSGAEVKKPGASVKVSCKASGYTFTDYIM HWVRQAPGQGLEWMGYINPYNDGSKYTEKFQGRVTM TSDTSISTAYMELSRLRSDDTAVYYCARGTYYYGSA LFDYWGQGTTVTVSS |
| 46 | VLCL- Light chain (20H4.9) | see Table 1 |

TABLE 51

Sequences of bispecific, bivalent anti-4-1BB/ monovalent anti-CD19 (8B8-018) human IgG1 P329GLALA antigen binding molecules (Constructs with a-CD19 VH fused to Fc hole chain and VL fused to Fc knob chain, termed hole-VH)

| SEQ ID NO: | Description | Sequence |
|---|---|---|
| 145 | VHCH1 (20H4.9)- Heavy chain hole-VH (8B8-018) | QVQLQQWGAGLLKPSETLSLTCAVYGGSFSGYYWSW IRQSPEKGLEWIGEINHGGYVTYNPSLESRVTISVD TSKNQFSLKLSSVTAADTAVYYCARDYGPGNYDWYF DLWGRGTLVTVSSASTKGPSVFPLAPSSKSTSGGTA ALGCLVKDYFPEPVTVSWNSGALTSGVHTFPAVLQS SGLYSLSSVVTVPSSSLGTQTYICNVNHKPSNTKVD KKVEPKSCDKTHTCPPCPAPEAAGGPSVFLFPPKPK DTLMISRTPEVTCVVVDVSHEDPEVKFNWYVDGVEV HNAKTKPREEQYNSTYRVVSVLTVLHQDWLNGKEYK CKVSNKALGAPIEKTISKAKGQPREPQVCTLPPSRD ELTKNQVSLSCAVKGFYPSDIAVEWESNGQPENNYK TTPPVLDSDGSFFLVSKLTVDKSRWQQGNVFSCSVM HEALHNHYTQKSLSLSPGGGGSGGGGSGGGGSGGG GSQVQLVQSGAEVKKPGASVKVSCKASGYTFTDYIM HWVRQAPGQGLEWMGYINPYNDGSKYTEKFQGRVTM TSDTSISTAYMELSRLRSDDTAVYYCARGTYYYGSA LFDYWGQGTTVTVSS |
| 146 | VHCH1 (20H4.9)- Heavy chain knob-VL (8B8-018) | QVQLQQWGAGLLKPSETLSLTCAVYGGSFSGYYWSW IRQSPEKGLEWIGEINHGGYVTYNPSLESRVTISVD TSKNQFSLKLSSVTAADTAVYYCARDYGPGNYDWYF DLWGRGTLVTVSSASTKGPSVFPLAPSSKSTSGGTA ALGCLVKDYFPEPVTVSWNSGALTSGVHTFPAVLQS SGLYSLSSVVTVPSSSLGTQTYICNVNHKPSNTKVD KKVEPKSCDKTHTCPPCPAPEAAGGPSVFLFPPKPK DTLMISRTPEVTCVVVDVSHEDPEVKFNWYVDGVEV HNAKTKPREEQYNSTYRVVSVLTVLHQDWLNGKEYK CKVSNKALGAPIEKTISKAKGQPREPQVYTLPPCRD ELTKNQVSLWCLVKGFYPSDIAVEWESNGQPENNYK TTPPVLDSDGSFFLYSKLTVDKSRWQQGNVFSCSVM HEALHNHYTQKSLSLSPGGGGSGGGGSGGGGSGGG GSDIVMTQTPLSLSVTPGQPASISCKSSQSLENPNG NTYLNWYLQKPGQSPQLLIYRVSKRFSGVPDRFSGS GSGTDFTLKISRVEAEDVGVYYCLQLTHVPYTFGQG TKLEIK |
| 46 | VLCL- Light chain (20H4.9) | see Table 1 |

The bispecific 2+1 anti-4-1BB anti-CD19 huIgG1 P329GLALA were produced by co-transfecting HEK293-EBNA cells with the mammalian expression vectors using polyethylenimine. The cells were transfected with the corresponding expression vectors in a 1:1:1 ratio ("vector knob heavy chain": "vector light chain":"vector hole heavy chain").

For production in 500 mL shake flasks, 400 million HEK293 EBNA cells were seeded 24 hours before transfection. For transfection cells were centrifuged for 5 minutes by 210×g, and supernatant was replaced by pre-warmed CD CHO medium. Expression vectors were mixed in 20 mL CD CHO medium to a final amount of 200m DNA. After addition of 540 µL PEI, the solution was vortexed for 15 seconds and incubated for 10 minutes at room temperature. Afterwards, cells were mixed with the DNA/PEI solution, transferred to a 500 mL shake flask and incubated for 3 hours at 37° C. in an incubator with a 5% $CO_2$ atmosphere. After the incubation, 160 mL F17 medium was added and cells were cultured for 24 hours. One day after transfection 1 mM valproic acid and 7% Feed were added. After culturing for 7 days, the cell supernatant was collected by centrifugation for 15 minutes at 210×g. The solution was sterile filtered (0.22 µm filter), supplemented with sodium azide to a final concentration of 0.01% (w/v), and kept at 4° C.

Secreted proteins were purified from cell culture supernatants by affinity chromatography using Protein A, followed by size exclusion chromatography. For affinity chromatography, the supernatant was loaded on a Protein A MabSelectSure column (CV=5 mL, GE Healthcare) equilibrated with 40 mL 20 mM sodium phosphate, 20 mM sodium citrate pH 7.5. Unbound protein was removed by washing with at least 10 column volumes of 20 mM sodium phosphate, 20 mM sodium citrate containing buffer (pH 7.5). The bound protein was eluted using a linear pH-gradient of sodium chloride (from 20 to 100 mM) created over 15 column volumes of 20 mM sodium citrate, 100 mM sodium chloride, 100 mM glycine, pH 3.0. The column was then washed with 10 column volumes of 20 mM sodium citrate, 100 mM NaCl, 100 mM Glycine, pH 3.0. The pH of collected fractions was adjusted by adding 1/40 (v/v) of 2M Tris, pH8.0. The protein was concentrated and filtered prior to loading on a HiLoad Superdex 16/600 S200 column (GE Healthcare) equilibrated with 20 mM histidine, 140 mM sodium chloride, pH 6.0.

The protein concentration of purified bispecific constructs was determined by measuring the OD at 280 nm, using the molar extinction coefficient calculated on the basis of the amino acid sequence. Purity and molecular weight of the bispecific constructs were analyzed by CE-SDS in the presence and absence of a reducing agent (Invitrogen, USA) using a LabChipGXII (Caliper). The aggregate content of bispecific constructs was analyzed using a TSKgel G3000 SW XL analytical size-exclusion column (Tosoh) equilibrated in a 25 mM $K_2HPO_4$, 125 mM NaCl, 200 mM L-Arginine Monohydrocloride, 0.02% (w/v) $NaN_3$, pH 6.7 running buffer at 25° C.

TABLE 52

Biochemical analysis of bispecific antigen binding molecules with a bivalent binding to 4-1BB and a monovalent binding to CD19 (2 + 1 anti-4-1BB, anti-CD19(2B11) human IgG1 P329GLALA and 2 + 1 anti-4-1BB, anti-CD19(8B8-018) human IgG1 P329GLALA)

| Molecule | Monomer [%] | Yield [mg/l] | CE-SDS (non-red) |
|---|---|---|---|
| 4-1BB (20H4.9)/CD19 (2B11) P329GLALA IgG1 2 + 1 (hole-VL) | 99 | 3 | 100 |
| 4-1BB (20H4.9)/CD19 (8B8-018) P329GLALA IgG1 2 + 1 (hole-VL) | 92 | 2 | 92 |

Example 9

Preparation, Purification and Characterization of Bispecific Antibodies with a Tetravalent Binding to 4-1BB and a Monovalent Binding to CD19

9.1 Generation of Bispecific Antibodies with a Tetravalent Binding to 4-1BB and a Monovalent Binding to CD19

Bispecific agonistic 4-1BB antibodies with tetravalent binding for 4-1BB and monovalent binding for CD19, also termed 4+1, were prepared as depicted in FIGS. 4A and 4B. The knobs into hole technology was applied by introducing the S354C/T366W mutations in the first heavy chain HC1 (Fc knob heavy chain) and introducing the Y349C/T366S/L368A/Y407V mutations in the second heavy chain HC2 (Fc hole heavy chain) to allow generation of a heterodimer.

In this example, the first heavy chain HC1 of the construct was comprised of the following components: VHCH1_VHCH1 of anti-4-1BB binder (clone 20H4.9), followed by Fc hole, at which C-terminus a VL or VH of anti-CD19 binder (clone 2B11 or 8B8-018) was fused. The second heavy chain HC2 was comprised of VHCH1_VHCH1 of anti-4-1BB binder (clone 20H4.9), followed by Fc knob, at which C-terminus a VH or VL, respectively, of anti-CD19 binder (clone 2B11 or 8B8-018) was fused. The generation and preparation of CD19 binders clone 2B11 or 8B8-018 is described in in WO 2016/075278 A1, which is incorporated herein by reference. For the 4-1BB binder, the VH and VL sequences of clone 20H4.9 were obtained in accordance with U.S. Pat. No. 7,288,638 B2 or U.S. Pat. No. 7,659,384 B2. Combination of the two heavy chains allows generation of a heterodimer, which includes a CD19 binding moiety and four 4-1BB binding Fabs.

The Pro329Gly, Leu234Ala and Leu235Ala mutations have been introduced in the constant region of the knob and hole heavy chains to abrogate binding to Fc gamma receptors according to the method described in International Patent Appl. Publ. No. WO2012/130831A1.

The bispecific 4+1 anti-4-1BB anti-CD19 huIgG1 P329GLALA antigen binding molecules were produced by co-transfecting HEK293-EBNA cells with the mammalian expression vectors using polyethylenimine. The cells were transfected with the corresponding expression vectors in a 1:1:1 ratio ("vector knob heavy chain": "vector light chain": "vector hole heavy chain").

The antigen binding molecule was produced and purified as described for the bispecific bivalent anti-4-1BB and anti-CD19 huIgG1 P329GLALA (see Example 8.1).

The amino acid sequences for 4+1 anti-4-1BB, anti-CD19 (2B11) constructs with a-CD19 VH fused to the Fc knob heavy chain and VL fused to Fc hole heavy chain can be found respectively in Table 53. The amino acid sequences for 4+1 anti-4-1BB, anti-CD19(2B11) constructs with a-CD19 VL fused to Fc knob heavy chain and VH fused to Fc hole heavy chain can be found respectively in Table 54.

TABLE 53

Sequences of bispecific, tetravalent anti-4-1BB/ monovalent anti-CD19 human IgG1 P329GLALA antigen binding molecules (4+1 Constructs with a-CD19 VL fused to Fc hole chain and VH fused to Fc knob chain, termed hole-VL)

| SEQ ID NO: | Description | Sequence |
|---|---|---|
| 147 | VHCH1-VHCH1 (20H4.9)-Heavy chain Fc hole-VL (2B11) | QVQLQQWGAGLLKPSETLSLTCAVYGGSFSGYYWSW IRQSPEKGLEWIGEINHGGYVTYNPSLESRVTISVD TSKNQFSLKLSSVTAADTAVYYCARDYGPGNYDWYF DLWGRGTLVTVSSASTKGPSVFPLAPSSKSTSGGTA ALGCLVKDYFPEPVTVSWNSGALTSGVHTFPAVLQS SGLYSLSSVVTVPSSSLGTQTYICNVNHKPSNTKVD KKVEPKSCDGGGGSGGGGSQVQLQQWGAGLLKPSET LSLTCAVYGGSFSGYYWSWIRQSPEKGLEWIGEINH GGYVTYNPSLESRVTISVDTSKNQFSLKLSSVTAAD TAVYYCARDYGPGNYDWYFDLWGRGTLVTVSSASTK GPSVFPLAPSSKSTSGGTAALGCLVKDYFPEPVTVS WNSGALTSGVHTFPAVLQSSGLYSLSSVVTVPSSSL GTQTYICNVNHKPSNTKVDKKVEPKSCDKTHTCPPC PAPEAAGGPSVFLFPPKPKDTLMISRTPEVTCVVVD VSHEDPEVKFNWYVDGVEVHNAKTKPREEQYNSTYR VVSVLTVLHQDWLNGKEYKCKVSNKALGAPIEKTIS KAKGQPREPQVCTLPPSRDELTKNQVSLSCAVKGFY PSDIAVEWESNGQPENNYKTTPPVLDSDGSFFLVSK LTVDKSRWQQGNVFSCSVMHEALHNHYTQKSLSLSP GGGGSGGGGSGGGGSGGGGSDIVMTQTPLSLSVTP GQPASISCKSSQSLETSTGTTYLNWYLQKPGQSPQL LIYRVSKRFSGVPDRFSGSGSGTDFTLKISRVEAED VGVYYCLQLLEDPYTFGQGTKLEIK |

TABLE 53-continued

Sequences of bispecific, tetravalent anti-4-1BB/ monovalent anti-CD19 human IgG1 P329GLALA antigen binding molecules (4+1 Constructs with a-CD19 VL fused to Fc hole chain and VH fused to Fc knob chain, termed hole-VL)

| SEQ ID NO: | Description | Sequence |
|---|---|---|
| 148 | VHCH1-VHCH1 (20H4.9)-Heavy chain Fc knob-VH (2B11) | QVQLQQWGAGLLKPSETLSLTCAVYGGSFSGYYWSW IRQSPEKGLEWIGEINHGGYVTYNPSLESRVTISVD TSKNQFSLKLSSVTAADTAVYYCARDYGPGNYDWYF DLWGRGTLVTVSSASTKGPSVFPLAPSSKSTSGGTA ALGCLVKDYFPEPVTVSWNSGALTSGVHTFPAVLQS SGLYSLSSVVTVPSSSLGTQTYICNVNHKPSNTKVD KKVEPKSCDGGGSGGGGSQVQLQQWGAGLLKPSET LSLTCAVYGGSFSGYYWSIRQSPEKGLEWIGEINH GGYVTYNPSLESRVTISVDTSKNQFSLKLSSVTAAD TAVYYCARDYGPGNYDWYFDLWGRGTLVTVSSASTK GPSVFPLAPSSKSTSGGTAALGCLVKDYFPEPVTVS WNSGALTSGVHTFPAVLQSSGLYSLSSVVTVPSSSL GTQTYICNVNHKPSNTKVDKKVEPKSCDKTHTCPPC PAPEAAGGPSVFLFPPKPKDTLMISRTPEVTCVVVD VSHEDPEVKFNWYVDGVEVHNAKTKPREEQYNSTYR VVSVLTVLHQDWLNGKEYKCKVSNKALGAPIEKTIS KAKGQPREPQVYTLPPCRDELTKNQVSLWCLVKGFY PSDIAVEWESNGQPENNYKTTPPVLDSDGSFFLYSK LTVDKSRWQQGNVFSCSVMHEALHNHYTQKSLSLSP GGGGSGGGGSGGGGSGGGGSQVQLVQSGAEVKKPG ASVKVSCKASGYTFTDYIMHWVRQAPGQGLEWMGYI NPYNDGSKYTEKFQGRVTMTSDTSISTAYMELSRLR SDDTAVYYCARGTYYYGPQLFDYWGQGTTVTVSS |
| 46 | VLCL-Light chain (20H4.9) | see Table 1 |

TABLE 54

Sequences of bispecific, tetravalent anti-4-1BB/ monovalent anti-CD19 (2B11) human IgG1 P329GLALA antigen binding molecules (Constructs with a-CD19 VH fused to Fc hole chain and VL fused to Fc knob chain, termed hole-VH)

| SEQ ID NO: | Description | Sequence |
|---|---|---|
| 149 | VHCH1-VHCH1 (20H4.9)-Heavy chain hole-VH (2B11) | QVQLQQWGAGLLKPSETLSLTCAVYGGSFSGYYWSW IRQSPEKGLEWIGEINHGGYVTYNPSLESRVTISVD TSKNQFSLKLSSVTAADTAVYYCARDYGPGNYDWYF DLWGRGTLVTVSSASTKGPSVFPLAPSSKSTSGGTA ALGCLVKDYFPEPVTVSWNSGALTSGVHTFPAVLQS SGLYSLSSVVTVPSSSLGTQTYICNVNHKPSNTKVD KKVEPKSCDGGGSGGGGSQVQLQQWGAGLLKPSET LSLTCAVYGGSFSGYYWSIRQSPEKGLEWIGEINH GGYVTYNPSLESRVTISVDTSKNQFSLKLSSVTAAD TAVYYCARDYGPGNYDWYFDLWGRGTLVTVSSASTK GPSVFPLAPSSKSTSGGTAALGCLVKDYFPEPVTVS WNSGALTSGVHTFPAVLQSSGLYSLSSVVTVPSSSL GTQTYICNVNHKPSNTKVDKKVEPKSCDKTHTCPPC PAPEAAGGPSVFLFPPKPKDTLMISRTPEVTCVVVD VSHEDPEVKFNWYVDGVEVHNAKTKPREEQYNSTYR VVSVLTVLHQDWLNGKEYKCKVSNKALGAPIEKTIS KAKGQPREPQVCTLPPSRDELTKNQVSLSCAVKGFY PSDIAVEWESNGQPENNYKTTPPVLDSDGSFFLVSK LTVDKSRWQQGNVFSCSVMHEALHNHYTQKSLSLSP GGGGSGGGGSGGGGSGGGGSQVQLVQSGAEVKKPG ASVKVSCKASGYTFTDYIMHWVRQAPGQGLEWMGYI NPYNDGSKYTEKFQGRVTMTSDTSISTAYMELSRLR SDDTAVYYCARGTYYYGPQLFDYWGQGTTVTVSS |

TABLE 54-continued

Sequences of bispecific, tetravalent anti-4-1BB/ monovalent anti-CD19 (2B11) human IgG1 P329GLALA antigen binding molecules (Constructs with a-CD19 VH fused to Fc hole chain and VL fused to Fc knob chain, termed hole-VH)

| SEQ ID NO: | Description | Sequence |
|---|---|---|
| 150 | VHCH1-VHCH1 (20H4.9)-Heavy chain knob-VL (2B11) | QVQLQQWGAGLLKPSETLSLTCAVYGGSFSGYYWSW IRQSPEKGLEWIGEINHGGYVTYNPSLESRVTISVD TSKNQFSLKLSSVTAADTAVYYCARDYGPGNYDWYF DLWGRGTLVTVSSASTKGPSVFPLAPSSKSTSGGTA ALGCLVKDYFPEPVTVSWNSGALTSGVHTFPAVLQS SGLYSLSSVVTVPSSSLGTQTYICNVNHKPSNTKVD KKVEPKSCDGGGGSGGGGSQVQLQQWGAGLLKPSET LSLTCAVYGGSFSGYYWSIRQSPEKGLEWIGEINH GGYVTYNPSLESRVTISVDTSKNQFSLKLSSVTAAD TAVYYCARDYGPGNYDWYFDLWGRGTLVTVSSASTK GPSVFPLAPSSKSTSGGTAALGCLVKDYFPEPVTVS WNSGALTSGVHTFPAVLQSSGLYSLSSVVTVPSSSL GTQTYICNVNHKPSNTKVDKKVEPKSCDKTHTCPPC PAPEAAGGPSVFLFPPKPKDTLMISRTPEVTCVVVD VSHEDPEVKFNWYVDGVEVHNAKTKPREEQYNSTYR VVSVLTVLHQDWLNGKEYKCKVSNKALGAPIEKTIS KAKGQPREPQVYTLPPCRDELTKNQVSLWCLVKGFY PSDIAVEWESNGQPENNYKTTPPVLDSDGSFFLYSK LTVDKSRWQQGNVFSCSVMHEALHNHYTQKSLSLSP GGGGSGGGGSGGGGSGGGGSDIVMTQTPLSLSVTP GQPASISCKSSQSLETSTGTTYLNWYLQKPGQSPQL LIYRVSKRFSGVPDRFSGSGSGTDFTLKISRVEAED VGVYYCLQLLEDPYTFGQGTKLEIK |
| 46 | VLCL-Light chain (20H4.9) | see Table 1 |

The amino acid sequences for 4+1 anti-4-1BB, anti-CD19 (8B8-018) constructs with a-CD19 VH fused to the Fc knob heavy chain and VL fused to Fc hole heavy chain can be found respectively in Table 55. The amino acid sequences for 4+1 anti-4-1BB, anti-CD19(8B8-018) constructs with a-CD19 VL fused to Fc knob heavy chain and VH fused to Fc hole heavy chain can be found respectively in Table 56.

TABLE 55

Sequences of bispecific, tetravalent anti-4-1BB/ monovalent anti-CD19 human IgG1 P329GLALA antigen binding molecules (4+1 Constructs with a-CD19(8B8-018) VL fused to Fc hole chain and VH fused to Fc knob chain, termed hole-VL)

| SEQ ID NO: | Description | Sequence |
|---|---|---|
| 151 | VHCH1-VHCH1 (20H4.9)-Heavy chain Fc hole-VL (8B8-018) | QVQLQQWGAGLLKPSETLSLTCAVYGGSFSGYYWSW IRQSPEKGLEWIGEINHGGYVTYNPSLESRVTISVD TSKNQFSLKLSSVTAADTAVYYCARDYGPGNYDWYF DLWGRGTLVTVSSASTKGPSVFPLAPSSKSTSGGTA ALGCLVKDYFPEPVTVSWNSGALTSGVHTFPAVLQS SGLYSLSSVVTVPSSSLGTQTYICNVNHKPSNTKVD KKVEPKSCDGGGSGGGGSQVQLQQWGAGLLKPSET LSLTCAVYGGSFSGYYWSIRQSPEKGLEWIGEINH GGYVTYNPSLESRVTISVDTSKNQFSLKLSSVTAAD TAVYYCARDYGPGNYDWYFDLWGRGTLVTVSSASTK GPSVFPLAPSSKSTSGGTAALGCLVKDYFPEPVTVS WNSGALTSGVHTFPAVLQSSGLYSLSSVVTVPSSSL GTQTYICNVNHKPSNTKVDKKVEPKSCDKTHTCPPC PAPEAAGGPSVFLFPPKPKDTLMISRTPEVTCVVVD VSHEDPEVKFNWYVDGVEVHNAKTKPREEQYNSTYR VVSVLTVLHQDWLNGKEYKCKVSNKALGAPIEKTIS KAKGQPREPQVCTLPPSRDELTKNQVSLSCAVKGFY |

TABLE 55-continued

Sequences of bispecific, tetravalent anti-4-1BB/ monovalent anti-CD19 human IgG1 P329GLALA antigen binding molecules (4+1 Constructs with a-CD19(8B8-018) VL fused to Fc hole chain and VH fused to Fc knob chain, termed hole-VL)

| SEQ ID NO: | Description | Sequence |
|---|---|---|
| | | PSDIAVEWESNGQPENNYKTTPPVLDSDGSFFLVSK LTVDKSRWQQGNVFSCSVMHEALHNHYTQKSLSLSP GGGGGSGGGGSGGGGSGGGGSDIVMTQTPLSLSVTP GQPASISCKSSQSLENPNGNTYLNWYLQKPGQSPQL LIYRVSKRFSGVPDRFSGSGSGTDFTLKISRVEAED VGVYYCLQLTHVPYTFGQGTKLEIK |
| 152 | VHCH1-VHCH1 (20H4.9)-Heavy chain Fc knob-VH (8B8-018) | QVQLQQWGAGLLKPSETLSLTCAVYGGSFSGYYWSW IRQSPEKGLEWIGEINHGGYVTYNPSLESRVTISVD TSKNQFSLKLSSVTAADTAVYYCARDYGPGNYDWYF DLWGRGTLVTVSSASTKGPSVFPLAPSSKSTSGGTA ALGCLVKDYFPEPVTVSWNSGALTSGVHTFPAVLQS SGLYSLSSVVTVPSSSLGTQTYICNVNHKPSNTKVD KKVEPKSCDGGGSGGGGSQVQLQQWGAGLLKPSET LSLTCAVYGGSFSGYYWSWIRQSPEKGLEWIGEINH GGYVTYNPSLESRVTISVDTSKNQFSLKLSSVTAAD TAVYYCARDYGPGNYDWYFDLWGRGTLVTVSSASTK GPSVFPLAPSSKSTSGGTAALGCLVKDYFPEPVTVS WNSGALTSGVHTFPAVLQSSGLYSLSSVVTVPSSSL GTQTYICNVNHKPSNTKVDKKVEPKSCDKTHTCPPC PAPEAAGGPSVFLFPPKPKDTLMISRTPEVTCVVVD VSHEDPEVKFNWYVDGVEVHNAKTKPREEQYNSTYR VVSVLTVLHQDWLNGKEYKCKVSNKALGAPIEKTIS KAKGQPREPQVYTLPPCRDELTKNQVSLWCLVKGFY PSDIAVEWESNGQPENNYKTTPPVLDSDGSFFLYSK LTVDKSRWQQGNVFSCSVMHEALHNHYTQKSLSLSP GGGGGSGGGGSGGGGSGGGGSQVQLVQSGAEVKKPG ASVKVSCKASGYTFTDYIMHWVRQAPGQGLEWMGYI NPYNDGSKYTEKFQGRVTMTSDTSISTAYMELSRLR SDDTAVYYCARGTYYYGSALFDYWG QGTTVTVSS |
| 46 | VLCL-Light chain (20H4.9) | see Table 1 |

TABLE 56

Sequences of bispecific, tetravalent anti-4-1BB/ monovalent anti-CD19 (8B8-018) human IgG1 P329GLALA antigen binding molecules (Constructs with a-CD19 VH fused to Fc hole chain and VL fused to Fc knob chain, termed hole-VH)

| SEQ ID NO: | Description | Sequence |
|---|---|---|
| 153 | VHCH1-VHCH1 (20H4.9)-Heavy chain hole-VH (8B8-018) | QVQLQQWGAGLLKPSETLSLTCAVYGGSFSGYYWSW IRQSPEKGLEWIGEINHGGYVTYNPSLESRVTISVD TSKNQFSLKLSSVTAADTAVYYCARDYGPGNYDWYF DLWGRGTLVTVSSASTKGPSVFPLAPSSKSTSGGTA ALGCLVKDYFPEPVTVSWNSGALTSGVHTFPAVLQS SGLYSLSSVVTVPSSSLGTQTYICNVNHKPSNTKVD KKVEPKSCDGGGSGGGGSQVQLQQWGAGLLKPSET LSLTCAVYGGSFSGYYWSWIRQSPEKGLEWIGEINH GGYVTYNPSLESRVTISVDTSKNQFSLKLSSVTAAD TAVYYCARDYGPGNYDWYFDLWGRGTLVTVSSASTK GPSVFPLAPSSKSTSGGTAALGCLVKDYFPEPVTVS WNSGALTSGVHTFPAVLQSSGLYSLSSVVTVPSSSL GTQTYICNVNHKPSNTKVDKKVEPKSCDKTHTCPPC PAPEAAGGPSVFLFPPKPKDTLMISRTPEVTCVVVD VSHEDPEVKFNWYVDGVEVHNAKTKPREEQYNSTYR VVSVLTVLHQDWLNGKEYKCKVSNKALGAPIEKTIS KAKGQPREPQVCTLPPSRDELTKNQVSLSCAVKGFY PSDIAVEWESNGQPENNYKTTPPVLDSDGSFFLVSK LTVDKSRWQQGNVFSCSVMHEALHNHYTQKSLSLSP GGGGSGGGGSGGGGSGGGGSQVQLVQSGAEVKKPG ASVKVSCKASGYTFTDYIMHWVRQAPGQGLEWMGYI NPYNDGSKYTEKFQGRVTMTSDTSISTAYMELSRLR SDDTAVYYCARGTYYYGSALFDYWGQGTTVTVSS |
| 154 | VHCH1-VHCH1 (20H4.9)-Heavy chain knob-VL (8B8-018) | QVQLQQWGAGLLKPSETLSLTCAVYGGSFSGYYWSW IRQSPEKGLEWIGEINHGGYVTYNPSLESRVTISVD TSKNQFSLKLSSVTAADTAVYYCARDYGPGNYDWYF DLWGRGTLVTVSSASTKGPSVFPLAPSSKSTSGGTA ALGCLVKDYFPEPVTVSWNSGALTSGVHTFPAVLQS SGLYSLSSVVTVPSSSLGTQTYICNVNHKPSNTKVD KKVEPKSCDGGGSGGGGSQVQLQQWGAGLLKPSET LSLTCAVYGGSFSGYYWSWIRQSPEKGLEWIGEINH GGYVTYNPSLESRVTISVDTSKNQFSLKLSSVTAAD TAVYYCARDYGPGNYDWYFDLWGRGTLVTVSSASTK GPSVFPLAPSSKSTSGGTAALGCLVKDYFPEPVTVS WNSGALTSGVHTFPAVLQSSGLYSLSSVVTVPSSSL GTQTYICNVNHKPSNTKVDKKVEPKSCDKTHTCPPC PAPEAAGGPSVFLFPPKPKDTLMISRTPEVTCVVVD VSHEDPEVKFNWYVDGVEVHNAKTKPREEQYNSTYR VVSVLTVLHQDWLNGKEYKCKVSNKALGAPIEKTIS KAKGQPREPQVYTLPPCRDELTKNQVSLWCLVKGFY PSDIAVEWESNGQPENNYKTTPPVLDSDGSFFLYSK LTVDKSRWQQGNVFSCSVMHEALHNHYTQKSLSLSP GGGGGSGGGGSGGGGSGGGGSDIVMTQTPLSLSVTP GQPASISCKSSQSLENPNGNTYLNWYLQKPGQSPQL LIYRVSKRFSGVPDRFSGSGSGTDFTLKISRVEAED VGVYYCLQLTHVPYTFGQGTKLEIK |
| 46 | VLCL-Light chain (20H4.9) | see Table 1 |

Example 10

Functional Characterization of Bispecific Antigen Binding Molecules Binding to 4-1BB and to CD19

10.1 Binding to CD19

The binding properties of bispecific, bivalent anti-4-1BB/monovalent anti-CD19 antibodies (called 4-1BBxCD19) to CD19 was measured on primary human B cells or on CD19 positive tumor cell lines (WSU-DLCL2 cells, DSMZ no. ACC 575). Briefly, total PBMCs were purified from buffycoats from healthy donors. Cells resuspended in DPBS (Gibco by Life Technologies, Cat. No. 14190 326) were added to each well of a round-bottom suspension cell 96-well plates (greiner bio-one, cellstar, Cat. No. 650185). Cells were washed once with 200 µL DPBS. Cells were resuspended in 100 µL/well of 4° C. cold DPBS buffer containing 1:5000 diluted Fixable Viability Dye eFluor 660 (eBioscience, Cat. No. 65-0864-18) and plates were incubated for 30 minutes at 4° C. Cells were washed once with 200 µL/well 4° C. cold DPBS buffer and resuspended in 50 µL/well of 4° C. cold FACS buffer (DPBS supplied with 2% FBS, 5 mM EDTA pH8 (Amresco, Cat. No. E177) and 7.5 mM Sodium azide (Sigma-Aldrich S2002)) containing the constructs 4-1BB(20H4.9)×CD19(2B11) 2+1, 4 1BB (20H4.9)×CD19(8B8-018) 2+1 (the structure of both is shown in FIG. 16A), CD19(2B11)×4-1BBL (FIG. 16B, described in WO 2016/075278 A1) and DP-47×4-1BBL (FIG. 16C, described in WO 2016/075278 A1) at a series of concentrations, followed by incubation for 1 hour at 4° C. After extensive washing, cells were further stained with 50 μL/well of 4° C. cold FACS buffer containing 5 μg/mL PE-conjugated AffiniPure anti-human IgG F(ab')$_2$-fragment-specific goat F(ab')2 fragment (Jackson ImmunoResearch, Cat. No. 109 116 098), and with an APC-H7-conjugated CD20 Ab (BD, Cat. No. 560734), and a APC-conjugated anti-CD3 Ab (Biolegend, Cat. No. 300312), and/or a FITC-conjugated anti-CD19 antibody (BD) for 30 minutes at 4° C. Cells were washed twice with 200 μL/well 4° C. FACS buffer and cells were fixed in 50 μL/well DPBS containing 1% Formaldehyde (Sigma, HT501320-9.5L). Cells were resuspended in 100 μL/well FACS-buffer and acquired using the FACS LSR II (BD Biosciences). Data were analyzed using FlowJo V10 (FlowJo, LLC) and GraphPad Prism 6.04 (GraphPad Software, Inc).

Cells were gated on CD3-CD20$^+$ living populations, and geo means of fluorescence intensity of PE-conjugated AffiniPure anti-human IgG IgG Fcγ-fragment-specific goat F(ab')2 fragment were plotted against the titrated concentration of constructs. As shown in FIGS. 17A and 17B, 4-1BB(20H4.9)×CD19(2B11) binds to human B cells in a dose-dependent manner, with a lower affinity as compared to CD19(2B11)×4-1BBL, while untargeted DP47×4-1BBL did not bind to B cells (FIG. 17A). Similarly, 4-1BB(20H4.9)×CD19(2B11) constructs binds to CD19$^+$ WSU tumor cells in a similar manner as to primary B cells. (FIG. 17B). 4-1BB (20H4.9)×CD19(8B8-018) shows an identical binding property as compared to 4-1BB(20H4.9)×CD19(2B11). In Table 57, the EC$_{50}$ values of the CD19$^+$ tumor binding curves are listed.

TABLE 57

EC$_{50}$ values of binding curves to CD1$^+$ tumor cells

| EC$_{50}$ (nM) | 4-1BB(20H4.9) × CD19(2B11) | 4-1BB(20H4.9) × CD19(8B8-018) | CD19(2B11) × 4-1BBL |
|---|---|---|---|
| B cell binding | 5.01 | 5.72 | 0.37 |
| WSU binding | 2.26 | 3.56 | 0.30 |

10.2 Binding to 4-1BB on Activated T Cells

To check the binding of 4-1BB×CD19 to 4-1BB expressing T cells, human PBMCs were pre-activated by TCR stimulation for the upregulation of 4-1BB on T cells for 48 hours. Purified PBMCs were diluted into a concentration of 2.8×10$^6$/ml resuspended in RPMI medium (Gibco, Cat No. 72400-054)+10% FBS (Gibco, Cat No. 20012-068) and 1% penicillin-Streptomycin (Gibco, Cat No. 15070-063) and 50 04 of 2-Mercaptoethanol (Gibco, Cat No. 31350-010). 90 μl of cells were added to each well of a round-bottom 96-well plates (greiner bio-one, cellstar, Cat. No. 650185). Then additional 50 μl anti-CD3 and anti-CD28 microbeads (Life Technologies, Cat No. 11131D) at 8×10$^5$ beads/ml were added to wells. Two days later, cells were washed with cold PBS (Gibco, 20012-068) one time, and resuspended with 90 μl of cold PBS, and incubated with 10 μl of solution containing constructs (4-1BB(20H4.9)×CD19(2B11), 4-1BB(20H4.9)×CD19(018) and CD19(2B11)×4-1BBL) 1 hour at 4° C. After extensive washing, cells were further stained with 50 μL/well of cold FACS buffer containing 5 μg/mL PE-conjugated AffiniPure anti-human IgG F(ab')2-fragment-specific goat F(ab')2 fragment (Jackson ImmunoResearch, Cat. No. 109 116 098), and additionally with anti-human CD3 (Biolegend, Cat No. 300312), CD4 (Biolegend, Cat No. 317434) and CD8 (Biolegend, Cat No. 344710) Ab for 30 minutes at 4° C. Cells were washed twice with 200 μL/well 4° C. FACS buffer and cells were fixed in 50 μL/well DPBS containing 1% Formaldehyde (Sigma, HT501320-9.5L). Cells were resuspended in 100 μL/well FACS-buffer and acquired using the FACS LSR II (BD Biosciences). Data was analyzed using FlowJo V10 (FlowJo, LLC) and GraphPad Prism 6.04 (GraphPad Software, Inc).

The specific binding was gated on pure population of CD4 and CD8 cells. 4-1BB(20H4.9)×CD19(2B11) showed excellent binding to 4-1BB expressing CD4 or CD8 T cells in a dose dependent manner, but with a slightly lower affinity as compared to CD19 (2B11)-4-1BBL (FIGS. 18A and 18B). 4-1BB(20H4.9)×CD19(018) shows an identical binding property as compared to 4-1BB(20H4.9)×CD19(2B11). In Table 58, the EC$_{50}$ values of the CD4$^+$ or CD8$^+$ T cell binding curves are listed.

TABLE 58

EC$_{50}$ values of binding curves to CD4$^+$ or CD8$^+$ tumor cells

| EC$_{50}$ (nM) | 4-1BB(20H4.9) × CD19(2B11) | 4-1BB(20H4.9) × CD19(018) | CD19(2B11) × 4-1BBL |
|---|---|---|---|
| CD4 binding | 2.05 | 2.63 | 0.37 |
| CD8 binding | 0.86 | 0.55 | 0.90 |

10.3 4-1BB×CD19 Showed Biological Activity

To measure the biological activities in physiological settings, activated human PBMCs were used to check the release of effector function molecule IFNγ by costimulating T cells and NK cells. Briefly, purified PBMCs co-cultured with constructs (4-1BB(20H4.9)×CD19(2B11), 4-1BB (20H4.9)×CD19(018), CD19(2B11)×4-1BBL and DP-47×4-1BBL) were added to the wells at a series of concentrations, and with additional 50 μl anti-CD3 and anti-CD28 microbeads (Life Technologies, Cat No. 11131D) at 8×10$^5$ beads/ml. After 48 hour incubation, the supernatant were collected for the measurement of IFN-γ by ELISA (DuoSet Human IFNg ELISA kit, R&D Systems, Cat No. DY285). FIG. 19 shows that both 4-1BB(20H4.9)×CD19(2B11) and CD19 (2B11)×4-1BBL constructs stimulated PBMCs to produce a similar amount of IFNγ in a dose dependent manner, whereas the untargeted DP47×4-1BBL (negative control) did not activate T or NK cells due to the lack of cross-linking. 4-1BB(20H4.9)×CD19(018) showed a similar biological activity as compared to 4-1BB(20H4.9)×CD19 (2B11). In Table 59, the EC$_{50}$ values of IFN-γ production are listed.

TABLE 59

EC$_{50}$ values of IFN-γ production

| EC$_{50}$ (nM) | 4-1BB(20H4.9) × CD19(2B11) | 4-1BB(20H4.9) × CD19(018) | CD19(2B11) × 4-1BBL |
|---|---|---|---|
| IFNγ production | 0.10 | 0.06 | 0.03 |

SEQUENCE LISTING (217 sequences)

SEQ ID NO: 1 - protein, 5 aa, Artificial Sequence
  4-1BB (20H4.9) CDR-H1
GYYWS

SEQ ID NO: 2 - protein, 16 aa, Artificial Sequence
  4-1BB (20H4.9) CDR-H2
EINHGGYVTYNPSLES

SEQ ID NO: 3 - protein, 13 aa, Artificial Sequence
  4-1BB (20H4.9) CDR-H3
DYGPGNYDWYFDL

SEQ ID NO: 4 - protein, 11 aa, Artificial Sequence
  4-1BB (20H4.9) CDR-L1
RASQSVSSYLA

SEQ ID NO: 5 - protein, 7 aa, Artificial Sequence
  4-1BB (20H4.9) CDR-L2
DASNRAT

SEQ ID NO: 6 - protein, 11 aa, Artificial Sequence
  4-1BB (20H4.9) CDR-L3
QQRSNWPPALT

SEQ ID NO: 7 - protein, 121 aa, Artificial Sequence [sequence omitted]

SEQ ID NO: 8 - protein, 109 aa, Artificial Sequence [sequence omitted]

SEQ ID NO: 9 - protein, 5 aa, Artificial Sequence
  FAP(28H1)  CDR-H1
SHAMS

SEQ ID NO: 10 - protein, 16 aa, Artificial Sequence
  FAP(28H1)  CDR-H2
AIWASGEQYYADSVKG

SEQ ID NO: 11 - protein, 8 aa, Artificial Sequence
  FAP(28H1)  CDR-H3
GWLGNFDY

SEQ ID NO: 12 - protein, 12 aa, Artificial Sequence
  FAP(28H1)  CDR-L1
RASQSVSRSYLA

SEQ ID NO: 13 - protein, 7 aa, Artificial Sequence
  FAP(28H1)  CDR-L2
GASTRAT

SEQ ID NO: 14 - protein, 9 aa, Artificial Sequence
  FAP(28H1)  CDR-L3
QQGQVIPPT

SEQ ID NO: 15 - protein, 5 aa, Artificial Sequence
  FAP(4B9)  CDR-H1
SYAMS

SEQ ID NO: 16 - protein, 17 aa, Artificial Sequence
  FAP(4B9)  CDR-H2
AIIGSGASTYYADSVKG

SEQ ID NO: 17 - protein, 8 aa, Artificial Sequence
  FAP(4B9)  CDR-H3
GWFGGFNY

SEQ ID NO: 18 - protein, 12 aa, Artificial Sequence
  FAP(4B9)  CDR-L1
RASQSVTSSYLA

SEQ ID NO: 19 - protein, 7 aa, Artificial Sequence
  FAP(4B9)  CDR-L2
VGSRRAT

SEQ ID NO: 20 - protein, 9 aa, Artificial Sequence
  FAP(4B9)  CDR-L3
QQGIMLPPT

SEQ ID NO: 21 - protein, 116 aa, Artificial Sequence
  FAP(28H1) VH
EVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSS

SEQ ID NO: 22 - protein, 108 aa, Artificial Sequence
  FAP(28H1) VL
EIVLTQSPGTLSLSPGERATLSCRASQSVSRSYLAWYQQKPGQAPRLLIIGASTRATGIPDRFSGSGSGTDFTLTISRLEPEDFAVYYCQQGQVIPPTFGQGTKVEIK

SEQ ID NO: 23 - protein, 117 aa, Artificial Sequence
  FAP(4B9) VH
EVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSS

SEQ ID NO: 24 - protein, 108 aa, Artificial Sequence
  FAP(4B9) VL
EIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIK

SEQ ID NO: 25 - protein, 5 aa, Artificial Sequence
  CEA (T84.66-LCHA)- CDR-H1
DTYMH

SEQ ID NO: 26 - protein, 17 aa, Artificial Sequence
  CEA (T84.66-LCHA)- CDR-H2
RIDPANGNSKYVPKFQG

SEQ ID NO: 27 - protein, 12 aa, Artificial Sequence
  CEA (T84.66-LCHA)- CDR-H3
FGYYVSDYAMAY

SEQ ID NO: 28 - protein, 15 aa, Artificial Sequence
  CEA (T84.66-LCHA)- CDR-L1
RAGESVDIFGVGFLH

SEQ ID NO: 29 - protein, 7 aa, Artificial Sequence
  CEA (T84.66-LCHA)- CDR-L2
RASNRAT

SEQ ID NO: 30 - protein, 9 aa, Artificial Sequence
  CEA (T84.66-LCHA)- CDR-L3
QQTNEDPYT

SEQ ID NO: 31 - protein, 121 aa, Artificial Sequence
  CEA (T84.66-LCHA) VH
QVQLVQSGAEVKKPGSSVKVSCKASGFNIKDTYMHWVRQAPGQGLEWMGRIDPANGNSKYVPKFQGRVTITADTSTSTAYMELSSLRSEDTAVYYCAPFGYYVSDYAMAYWGQGTLVTVSS

SEQ ID NO: 32 - protein, 111 aa, Artificial Sequence
  CEA (T84.66-LCHA) VL
EIVLTQSPATLSLSPGERATLSCRAGESVDIFGVGFLHWYQQKPGQAPRLLIYRASNRATGIPARFSGSGSGTDFTLTISSLEPEDFAVYYCQQTNEDPYTFGQGTKLEIK

SEQ ID NO: 33 - protein, 5 aa, Artificial Sequence
  CEA (A5B7)- CDR-H1
SYWMH

SEQ ID NO: 34 - protein, 16 aa, Artificial Sequence
  CEA (A5B7)- CDR-H2
FIRNKANGGTTEYAAS

SEQ ID NO: 35 - protein, 10 aa, Artificial Sequence
  CEA (A5B7)- CDR-H3
DRGLRFYFDY

SEQ ID NO: 36 - protein, 14 aa, Artificial Sequence
  CEA (A5B7)- CDR-L1
TLRRGINVGAYSIY

SEQ ID NO: 37 - protein, 11 aa, Artificial Sequence
  CEA (A5B7)- CDR-L2
YKSDSDKQQGS

SEQ ID NO: 38 - protein, 10 aa, Artificial Sequence
  CEA (A5B7)- CDR-L3
MIWHSGASAV

SEQ ID NO: 39 - protein, 121 aa, Artificial Sequence
  CEA (A5B7) VH
EVQLVESGGGLVQPGRSLRLSCAASGFTVSSYWMHWVRQAPGKGLEWVGFIRNKANGGTTEYAASVKGRFTISRDDSKNTLYLQMNSLRAEDTAVYYCARDRGLRFYFDYWGQGTTVTVSS

SEQ ID NO: 40 - protein, 116 aa, Artificial Sequence
  CEA (A5B7) VL
QAVLTQPASLSASPGASASLTCTLRRGINVGAYSIYWYQQKPGSPPQYLLRYKSDSDKQQGSGVSSRFSASKDASANAGILLISGLQSEDEADYYCMIWHSGASAVFGGGTKLTVL

SEQ ID NO: 41 - DNA, 1734 bp, Artificial Sequence
  VHCH1 (20H4.9)-Heavy chain hole-VL (4B9 ) (nucleotide sequence)
caggtgcagctgcagcagtggggagccggactgctgaagcctagcgagacactgagcctgacctgcgccgtgtacggcggcagcttcagcggctactactggtcctggatcagacagagccccgagaagggcctggaatggatcggcgagatcaaccacggcggctacgtgacctacaaccccagcctggaaagcagagtgaccatcagcgtggacaccagcaagaaccagttcagcctgaagctgagcagcgtgacagccgccgacacagccgtgtactactgcgccagagattacggccctggcaactacgactggtacttcgacctgtggggcagaggcaccctcgtgaccgtgtctagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccggcggcggaggttccggaggcggaggatccgagatcgtgctgacccagtctcccggcaccctgtctctgagccctggcgagagagccaccctgtcctgcagagcctcccagtccgtgacctcctcctacctcgcctggtatcagcagaagcccggccaggcccctcggctgctgatcaacgtgggcagtcggagagccaccggcatccctgaccggttctccggctctggctccggcaccgacttcaccctgaccatctcccggctggaacccgaggacttcgccgtgtactactgccagcagggcatcatgctgccccccacctttggccagggcaccaaggtggaaatcaag

SEQ ID NO: 42 - DNA, 1761 bp, Artificial Sequence
  VHCH1 (20H4.9)-Heavy chain knob-VH (4B9 ) (nucleotide sequence)
caggtgcagctgcagcagtggggagccggactgctgaagcctagcgagacactgagcctgacctgcgccgtgtacggcggcagcttcagcggctactactggtcctggatcagacagagccccgagaagggcctggaatggatcggcgagatcaaccacggcggctacgtgacctacaaccccagcctggaaagcagagtgaccatcagcgtggacaccagcaagaaccagttcagcctgaagctgagcagcgtgacagccgccgacacagccgtgtactactgcgccagagattacggccctggcaactacgactggtacttcgacctgtggggcagaggcaccctcgtgaccgtgtctagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatctgggggcggaggttccggaggcggtggatctgaggtgcagctgctcgaaagcggcggaggactggtgcagcctggcggcagcctgagactgtcttgcgccgccagcggcttcaccttcagcagctacgccatgagctgggtccgccaggcccctggcaagggactggaatgggtgtccgccatcatcggctctggcgccagcacctactacgccgacagcgtgaagggccggttcaccatcagccgggacaacagcaagaacaccctgtacctgcagatgaacagcctgcgggccgaggacaccgccgtgtactactgcgccaagggatggttcggcggcttcaactactggggacagggcaccctggtcaccgtgtccagc

SEQ ID NO: 43 - DNA, 648 bp, Artificial Sequence
  VLCL-Light chain (20H4.9) (nucleotide sequence)
gagatcgtgctgacccagagccccgccaccctgtctctgagccctggcgagagagccaccctgagctgcagagccagccagagcgtgtccagctacctggcttggtatcagcagaagcccggccaggcccccagactgctgatctacgacgccagcaaccgggccaccggcatccctgccagattttctggcagcggcagcggcaccgacttcaccctgaccatcagcagcctggaacccgaggacttcgccgtgtactactgccagcagcggagcaactggccccctgccctgaccttcggcggcggcaccaaggtggaaatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 44 - protein, 578 aa, Artificial Sequence
  VHCH1 (20H4.9)-Heavy chain hole-VL (4B9)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSEIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIK

SEQ ID NO: 45 - protein, 587 aa, Artificial Sequence
  VHCH1 (20H4.9)-Heavy chain knob-VH (4B9)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSS

SEQ ID NO: 46 - protein, 216 aa, Artificial Sequence
  VLCL-Light chain (20H4.9)
EIVLTQSPATLSLSPGERATLSCRASQSVSSYLAWYQQKPGQAPRLLIYDASNRATGIPARFSGSGSGTDFTLTISSLEPEDFAVYYCQQRSNWPPALTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 47 - DNA, 1761 bp, Artificial Sequence
  VHCH1 (20H4.9)-Heavy chain hole-VH (4B9) (nucleotide sequence)
caggtgcagctgcagcagtggggagccggcctgctgaagcccagcgagacactgagcctgacctgcgccgtgtacggcggcagcttcagcggctactactggtcctggatccggcagagccccgagaagggcctggaatggatcggcgagatcaaccacggcggctacgtgacctacaaccccagcctggaaagcagagtgaccatcagcgtggacaccagcaagaaccagttcagcctgaagctgagcagcgtgacagccgccgacaccgccgtgtactactgcgccagagactacggccctggcaactacgactggtacttcgacctgtggggcagaggcaccctggtgacagtgtccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccggcggcggaggttccggaggcggaggatccgaggtgcagctgctcgaaagcggcggaggactggtgcagcctggcggcagcctgagactgtcttgcgccgccagcggcttcaccttcagcagctacgccatgagctgggtccgccaggcccctggcaagggactggaatgggtgtccgccatcatcggctctggcgccagcacctactacgccgacagcgtgaagggccggttcaccatcagccgggacaacagcaagaacaccctgtacctgcagatgaacagcctgcgggccgaggacaccgccgtgtactactgcgccaagggatggttcggcggcttcaactactggggacagggcaccctggtcaccgtgtccagc

SEQ ID NO: 48 - DNA, 1733 bp, Artificial Sequence
  VHCH1 (20H4.9)-Heavy chain knob-VL (4B9) (nucleotide sequence)
aggtgcagctgcagcagtggggagccggcctgctgaagcccagcgagacactgagcctgacctgcgccgtgtacggcggcagcttcagcggctactactggtcctggatccggcagagccccgagaagggcctggaatggatcggcgagatcaaccacggcggctacgtgacctacaaccccagcctggaaagcagagtgaccatcagcgtggacaccagcaagaaccagttcagcctgaagctgagcagcgtgacagccgccgacaccgccgtgtactactgcgccagagactacggccctggcaactacgactggtacttcgacctgtggggcagaggcaccctggtgacagtgtccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatctgggggcggaggttccggaggcggtggatctgagatcgtgctgacccagtctcccggcaccctgtctctgagccctggcgagagagccaccctgtcctgcagagcctcccagtccgtgacctcctcctacctcgcctggtatcagcagaagcccggccaggcccctcggctgctgatcaacgtgggcagtcggagagccaccggcatccctgaccggttctccggctctggctccggcaccgacttcaccctgaccatctcccggctggaacccgaggacttcgccgtgtactactgccagcagggcatcatgctgccccccacctttggccagggcaccaaggtggaaatcaag

SEQ ID NO: 49 - protein, 587 aa, Artificial Sequence
  VHCH1 (20H4.9)-Heavy chain hole-VH (4B9)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSEVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSS

SEQ ID NO: 50 - protein, 578 aa, Artificial Sequence
  VHCH1 (20H4.9)-Heavy chain knob-VL (4B9)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIK

SEQ ID NO: 51 - DNA, 681 bp, Artificial Sequence
  Nucleotide sequence Fc hole chain
gacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 52 - DNA, 1266 bp, Artificial Sequence
  Nucleotide sequence human 4-1BB antigen Fc knob chain
ctgcaggacccctgcagcaactgccctgccggcaccttctgcgacaacaaccggaaccagatctgcagcccctgcccccccaacagcttcagctctgccggcggacagcggacctgcgacatctgcagacagtgcaagggcgtgttcagaacccggaaagagtgcagcagcaccagcaacgccgagtgcgactgcacccccggcttccattgtctgggagccggctgcagcatgtgcgagcaggactgcaagcagggccaggaactgaccaagaagggctgcaaggactgctgcttcggcaccttcaacgaccagaagcggggcatctgccggccctggaccaactgtagcctggacggcaagagcgtgctggtcaacggcaccaaagaacgggacgtcgtgtgcggccccagccctgctgatctgtctcctggggccagcagcgtgacccctcctgcccctgccagagagcctggccactctcctcaggtcgacgaacagttatattttcagggcggctcacccaaatctgcagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggcctgaacgacatcttcgaggcccagaagattgaatggcacgag

SEQ ID NO: 53 - protein, 227 aa, Artificial Sequence
  Fc hole chain
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 54 - protein, 422 aa, Artificial Sequence
  human 4-1BB antigen Fc knob chain
LQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQVDEQLYFQGGSPKSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGKSGGLNDIFEAQKIEWHE

SEQ ID NO: 55 - DNA, 2439 bp, Artificial Sequence
  VHCH1-VHCH1 (20H4.9)-Heavy chain hole-VL(4B9) (nucleotide sequence)
caggtgcagctgcagcagtggggagccggactgctgaagcctagcgagacactgagcctgacctgcgccgtgtacggcggcagcttcagcggctactactggtcctggatcagacagagccccgagaagggcctggaatggatcggcgagatcaaccacggcggctacgtgacctacaaccccagcctggaaagcagagtgaccatcagcgtggacaccagcaagaaccagttcagcctgaagctgagcagcgtgacagccgccgacacagccgtgtactactgcgccagagattacggccctggcaactacgactggtacttcgacctgtggggcagaggcaccctcgtgaccgtgtctagcgcttctaccaagggccccagcgtgttccctctggcccctagcagcaagagcacatctggcggaacagccgccctgggctgcctcgtgaaggactactttcccgagcccgtgacagtgtcctggaactctggcgccctgacaagcggcgtgcacacctttccagccgtgctgcagagcagcggcctgtactctctgagcagcgtcgtgactgtgcccagcagcagcctgggaacccagacctacatctgcaacgtgaaccacaagcccagcaacaccaaggtggacaagaaggtggaacccaagagctgcgacggcggaggcggatctggcggcggaggatcccaggtgcagctgcagcagtggggcgctggcctgctgaaaccctctgagactctgtccctgacatgtgctgtgtatggcggctccttctccggctactattggagctggattcggcagtcccctgagaaaggactggaatggattggggaaatcaatcatgggggatatgtgacatacaatccctcactggaatcccgcgtgaccatctccgtggatacctctaagaatcagttctctctgaagctgtcctccgtgaccgccgctgataccgctgtgtattactgtgcccgggactacggacccggcaattatgattggtattttgatctgtggggacggggcacactcgtgactgtgtcctctgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccggcggcggaggttccggaggcggtggatctgagatcgtgctgacccagtctcccggcaccctgtctctgagccctggcgagagagccaccctgtcctgcagagcctcccagtccgtgacctcctcctacctcgcctggtatcagcagaagcccggccaggcccctcggctgctgatcaacgtgggcagtcggagagccaccggcatccctgaccggttctccggctctggctccggcaccgacttcaccctgaccatctcccggctggaacccgaggacttcgccgtgtactactgccagcagggcatcatgctgccccccacctttggccagggcaccaaggtggaaatcaag

SEQ ID NO: 56 - DNA, 2466 bp, Artificial Sequence
  VHCH1-VHCH1 (20H4.9)-Heavy chain knob-VH(4B9) (nucleotide sequence)
caggtgcagctgcagcagtggggagccggactgctgaagcctagcgagacactgagcctgacctgcgccgtgtacggcggcagcttcagcggctactactggtcctggatcagacagagccccgagaagggcctggaatggatcggcgagatcaaccacggcggctacgtgacctacaaccccagcctggaaagcagagtgaccatcagcgtggacaccagcaagaaccagttcagcctgaagctgagcagcgtgacagccgccgacacagccgtgtactactgcgccagagattacggccctggcaactacgactggtacttcgacctgtggggcagaggcaccctcgtgaccgtgtctagcgcttctaccaagggccccagcgtgttccctctggcccctagcagcaagagcacatctggcggaacagccgccctgggctgcctcgtgaaggactactttcccgagcccgtgacagtgtcctggaactctggcgccctgacaagcggcgtgcacacctttccagccgtgctgcagagcagcggcctgtactctctgagcagcgtcgtgactgtgcccagcagcagcctgggaacccagacctacatctgcaacgtgaaccacaagcccagcaacaccaaggtggacaagaaggtggaacccaagagctgcgacggcggaggcggatctggcggcggaggatcccaggtgcagctgcagcagtggggcgctggcctgctgaaaccctctgagactctgtccctgacatgtgctgtgtatggcggctccttctccggctactattggagctggattcggcagtcccctgagaaaggactggaatggattggggaaatcaatcatgggggatatgtgacatacaatccctcactggaatcccgcgtgaccatctccgtggatacctctaagaatcagttctctctgaagctgtcctccgtgaccgccgctgataccgctgtgtattactgtgcccgggactacggacccggcaattatgattggtattttgatctgtggggacggggcacactcgtgactgtgtcctctgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatctgggggcggaggttccggaggcggaggatccgaggtgcagctgctcgaaagcggcggaggactggtgcagcctggcggcagcctgagactgtcttgcgccgccagcggcttcaccttcagcagctacgccatgagctgggtccgccaggcccctggcaagggactggaatgggtgtccgccatcatcggctctggcgccagcacctactacgccgacagcgtgaagggccggttcaccatcagccgggacaacagcaagaacaccctgtacctgcagatgaacagcctgcgggccgaggacaccgccgtgtactactgcgccaagggatggttcggcggcttcaactactggggacagggcaccctggtcaccgtgtccagc

SEQ ID NO: 57 - protein, 813 aa, Artificial Sequence
  VHCH1-VHCH1 (20H4.9)-Heavy chain hole-VL (4B9)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSQVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSEIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIK

SEQ ID NO: 58 - protein, 822 aa, Artificial Sequence
  VHCH1-VHCH1 (20H4.9)-Heavy chain knob-VH (4B9)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSQVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSS

SEQ ID NO: 59 - DNA, 2466 bp, Artificial Sequence
  VHCH1-VHCH1 (20H4.9)-Heavy chain hole-VH (4B9) (nucleotide sequence)
caggtgcagctgcagcagtggggagccggactgctgaagcctagcgagacactgagcctgacctgcgccgtgtacggcggcagcttcagcggctactactggtcctggatcagacagagccccgagaagggcctggaatggatcggcgagatcaaccacggcggctacgtgacctacaaccccagcctggaaagcagagtgaccatcagcgtggacaccagcaagaaccagttcagcctgaagctgagcagcgtgacagccgccgacacagccgtgtactactgcgccagagattacggccctggcaactacgactggtacttcgacctgtggggcagaggcaccctcgtgaccgtgtctagcgcttccacaaagggccccagcgtgttccctctggcccctagcagcaagagcacatctggcggaacagccgccctgggctgcctcgtgaaggactactttcccgagcccgtgacagtgtcctggaactctggcgccctgacaagcggcgtgcacacctttccagccgtgctgcagagcagcggcctgtactctctgtccagcgtcgtgactgtgcccagcagcagcctgggcacccagacctacatctgcaacgtgaaccacaagcccagcaacaccaaggtggacaagaaggtggaacccaagagctgcgacggcggaggcggatctggcggcggaggatcccaggtgcagctgcagcagtggggcgctggcctgctgaaaccctctgagactctgtccctgacatgtgctgtgtatggcggctccttctccggctactattggagctggattcggcagtcccctgagaaaggactggaatggattggggaaatcaatcatgggggatatgtgacatacaatccctcactggaatcccgcgtgaccatctccgtggatacctctaagaatcagttctctctgaagctgtcctccgtgaccgccgctgataccgctgtgtattactgtgcccgggactacggacccggcaattatgattggtattttgatctgtggggacggggcacactcgtgactgtgtcctctgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccggcggcggaggttccggaggcggaggatccgaggtgcagctgctcgaaagcggcggaggactggtgcagcctggcggcagcctgagactgtcttgcgccgccagcggcttcaccttcagcagctacgccatgagctgggtccgccaggcccctggcaagggactggaatgggtgtccgccatcatcggctctggcgccagcacctactacgccgacagcgtgaagggccggttcaccatcagccgggacaacagcaagaacaccctgtacctgcagatgaacagcctgcgggccgaggacaccgccgtgtactactgcgccaagggatggttcggcggcttcaactactggggacagggcaccctggtcaccgtgtccagc

SEQ ID NO: 60 - DNA, 2439 bp, Artificial Sequence
  VHCH1-VHCH1 (20H4.9)-Heavy chain knob-VL (4B9) (nucleotide sequence)
caggtgcagctgcagcagtggggagccggactgctgaagcctagcgagacactgagcctgacctgcgccgtgtacggcggcagcttcagcggctactactggtcctggatcagacagagccccgagaagggcctggaatggatcggcgagatcaaccacggcggctacgtgacctacaaccccagcctggaaagcagagtgaccatcagcgtggacaccagcaagaaccagttcagcctgaagctgagcagcgtgacagccgccgacacagccgtgtactactgcgccagagattacggccctggcaactacgactggtacttcgacctgtggggcagaggcaccctcgtgaccgtgtctagcgcttccacaaagggccccagcgtgttccctctggcccctagcagcaagagcacatctggcggaacagccgccctgggctgcctcgtgaaggactactttcccgagcccgtgacagtgtcctggaactctggcgccctgacaagcggcgtgcacacctttccagccgtgctgcagagcagcggcctgtactctctgtccagcgtcgtgactgtgcccagcagcagcctgggcacccagacctacatctgcaacgtgaaccacaagcccagcaacaccaaggtggacaagaaggtggaacccaagagctgcgacggcggaggcggatctggcggcggaggatcccaggtgcagctgcagcagtggggcgctggcctgctgaaaccctctgagactctgtccctgacatgtgctgtgtatggcggctccttctccggctactattggagctggattcggcagtcccctgagaaaggactggaatggattggggaaatcaatcatgggggatatgtgacatacaatccctcactggaatcccgcgtgaccatctccgtggatacctctaagaatcagttctctctgaagctgtcctccgtgaccgccgctgataccgctgtgtattactgtgcccgggactacggacccggcaattatgattggtattttgatctgtggggacggggcacactcgtgactgtgtcctctgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatctgggggcggaggttccggaggcggtggatctgagatcgtgctgacccagtctcccggcaccctgtctctgagccctggcgagagagccaccctgtcctgcagagcctcccagtccgtgacctcctcctacctcgcctggtatcagcagaagcccggccaggcccctcggctgctgatcaacgtgggcagtcggagagccaccggcatccctgaccggttctccggctctggctccggcaccgacttcaccctgaccatctcccggctggaacccgaggacttcgccgtgtactactgccagcagggcatcatgctgccccccacctttggccagggcaccaaggtggaaatcaag

SEQ ID NO: 61 - protein, 822 aa, Artificial Sequence
  VHCH1-VHCH1 (20H4.9)-Heavy chain hole-VH (4B9)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSQVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSEVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSS

SEQ ID NO: 62 - protein, 813 aa, Artificial Sequence
  VHCH1-VHCH1 (20H4.9)-Heavy chain knob-VL (4B9)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSQVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIK

SEQ ID NO: 63 - DNA, 1743 bp, Artificial Sequence
  VHCH1 (20H4.9)-Heavy chain hole-VL (T84.66-LCHA) (nucleotide sequence)
caggtgcagctgcagcagtggggagccggcctgctgaagcccagcgagacactgagcctgacctgcgccgtgtacggcggcagcttcagcggctactactggtcctggatccggcagagccccgagaagggcctggaatggatcggcgagatcaaccacggcggctacgtgacctacaaccccagcctggaaagcagagtgaccatcagcgtggacaccagcaagaaccagttcagcctgaagctgagcagcgtgacagccgccgacaccgccgtgtactactgcgccagagactacggccctggcaactacgactggtacttcgacctgtggggcagaggcaccctggtgacagtgtccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccggcggcggaggttccggaggcggaggatccgagatcgtgctgacccagagccctgccaccctgtcactgtctccaggcgagagagccaccctgagctgtagagccggcgagagcgtggacatcttcggcgtgggatttctgcactggtatcagcagaagcccggccaggcccccagactgctgatctacagagccagcaaccgggccacaggcatccccgccagattttctggctctggcagcggcaccgacttcaccctgacaatcagcagcctggaacccgaggacttcgccgtgtactactgccagcagaccaacgaggacccctacacctttggccagggcaccaagctggaaatcaag

SEQ ID NO: 64 - DNA, 1773 bp, Artificial Sequence
  VHCH1 (20H4.9)-Heavy chain knob-VH (T84.66-LCHA) (nucleotide sequence)
caggtgcagctgcagcagtggggagccggcctgctgaagcccagcgagacactgagcctgacctgcgccgtgtacggcggcagcttcagcggctactactggtcctggatccggcagagccccgagaagggcctggaatggatcggcgagatcaaccacggcggctacgtgacctacaaccccagcctggaaagcagagtgaccatcagcgtggacaccagcaagaaccagttcagcctgaagctgagcagcgtgacagccgccgacaccgccgtgtactactgcgccagagactacggccctggcaactacgactggtacttcgacctgtggggcagaggcaccctggtgacagtgtccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatctgggggcggaggttccggaggcggtggatctcaggtgcagctggtgcagtctggcgccgaagtgaagaaacccggcagcagcgtgaaggtgtcctgcaaggccagcggcttcaacatcaaggacacctacatgcactgggtgcgccaggcccctggacagggactggaatggatgggcagaatcgaccccgccaacggcaacagcaaatacgtgcccaagttccagggcagagtgaccatcaccgccgacaccagcacctccaccgcctacatggaactgagcagcctgcggagcgaggacaccgccgtgtactactgtgcccccttcggctactacgtgtccgactacgccatggcctattggggccagggcacactcgtgaccgtgtcctct

SEQ ID NO: 65 - protein, 581 aa, Artificial Sequence
  VHCH1 (20H4.9)-Heavy chain hole-VL (T84.66-LCHA)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSEIVLTQSPATLSLSPGERATLSCRAGESVDIFGVGFLHWYQQKPGQAPRLLIYRASNRATGIPARFSGSGSGTDFTLTISSLEPEDFAVYYCQQTNEDPYTFGQGTKLEIK

SEQ ID NO: 66 - protein, 591 aa, Artificial Sequence
  VHCH1 (20H4.9)-Heavy chain knob-VH (T84.66-LCHA)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVQSGAEVKKPGSSVKVSCKASGFNIKDTYMHWVRQAPGQGLEWMGRIDPANGNSKYVPKFQGRVTITADTSTSTAYMELSSLRSEDTAVYYCAPFGYYVSDYAMAYWGQGTLVTVSS

SEQ ID NO: 67 - DNA, 1773 bp, Artificial Sequence
  VHCH1 (20H4.9)-Heavy chain hole-VH (T84.66-LCHA) (nucleotide sequence)
caggtgcagctgcagcagtggggagccggcctgctgaagcccagcgagacactgagcctgacctgcgccgtgtacggcggcagcttcagcggctactactggtcctggatccggcagagccccgagaagggcctggaatggatcggcgagatcaaccacggcggctacgtgacctacaaccccagcctggaaagcagagtgaccatcagcgtggacaccagcaagaaccagttcagcctgaagctgagcagcgtgacagccgccgacaccgccgtgtactactgcgccagagactacggccctggcaactacgactggtacttcgacctgtggggcagaggcaccctggtgacagtgtccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccggcggcggaggttccggaggcggaggatcccaggtgcagctggtgcagtctggcgccgaagtgaagaaacccggcagcagcgtgaaggtgtcctgcaaggccagcggcttcaacatcaaggacacctacatgcactgggtgcgccaggcccctggacagggactggaatggatgggcagaatcgaccccgccaacggcaacagcaaatacgtgcccaagttccagggcagagtgaccatcaccgccgacaccagcacctccaccgcctacatggaactgagcagcctgcggagcgaggacaccgccgtgtactactgtgcccccttcggctactacgtgtccgactacgccatggcctattggggccagggcacactcgtgaccgtgtcctct

SEQ ID NO: 68 - DNA, 1743 bp, Artificial Sequence
  VHCH1 (20H4.9)-Heavy chain knob-VL (T84.66-LCHA) (nucleotide sequence)
caggtgcagctgcagcagtggggagccggcctgctgaagcccagcgagacactgagcctgacctgcgccgtgtacggcggcagcttcagcggctactactggtcctggatccggcagagccccgagaagggcctggaatggatcggcgagatcaaccacggcggctacgtgacctacaaccccagcctggaaagcagagtgaccatcagcgtggacaccagcaagaaccagttcagcctgaagctgagcagcgtgacagccgccgacaccgccgtgtactactgcgccagagactacggccctggcaactacgactggtacttcgacctgtggggcagaggcaccctggtgacagtgtccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatctgggggcggaggttccggaggcggtggatctgagatcgtgctgacccagagccctgccaccctgtcactgtctccaggcgagagagccaccctgagctgtagagccggcgagagcgtggacatcttcggcgtgggatttctgcactggtatcagcagaagcccggccaggcccccagactgctgatctacagagccagcaaccgggccacaggcatccccgccagattttctggctctggcagcggcaccgacttcaccctgacaatcagcagcctggaacccgaggacttcgccgtgtactactgccagcagaccaacgaggacccctacacctttggccagggcaccaagctggaaatcaag

SEQ ID NO: 69 - protein, 591 aa, Artificial Sequence
  VHCH1 (20H4.9)-Heavy chain hole-VH (T84.66-LCHA)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSQVQLVQSGAEVKKPGSSVKVSCKASGFNIKDTYMHWVRQAPGQGLEWMGRIDPANGNSKYVPKFQGRVTITADTSTSTAYMELSSLRSEDTAVYYCAPFGYYVSDYAMAYWGQGTLVTVSS

SEQ ID NO: 70 - protein, 581 aa, Artificial Sequence
  VHCH1 (20H4.9)-Heavy chain knob-VL (T84.66-LCHA)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPATLSLSPGERATLSCRAGESVDIFGVGFLHWYQQKPGQAPRLLIYRASNRATGIPARFSGSGSGTDFTLTISSLEPEDFAVYYCQQTNEDPYTFGQGTKLEIK

SEQ ID NO: 71 - DNA, 1758 bp, Artificial Sequence
  VHCH1 (20H4.9)-Heavy chain hole-VL (A5B7) (nucleotide sequence)
caggtgcagctgcagcagtggggagccggcctgctgaagcccagcgagacactgagcctgacctgcgccgtgtacggcggcagcttcagcggctactactggtcctggatccggcagagccccgagaagggcctggaatggatcggcgagatcaaccacggcggctacgtgacctacaaccccagcctggaaagcagagtgaccatcagcgtggacaccagcaagaaccagttcagcctgaagctgagcagcgtgacagccgccgacaccgccgtgtactactgcgccagagactacggccctggcaactacgactggtacttcgacctgtggggcagaggcaccctggtgacagtgtccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccggcggcggaggttccggaggcggaggatcccaggccgtgctgacacagcctgccagcctgtctgcttctcctggcgcctctgcctccctgacctgcacactgagaagaggcatcaacgtgggcgcctacagcatctactggtatcagcagaagcccggcagcccccctcagtacctgctgagatacaagagcgacagcgacaagcagcagggcagcggcgtgtccagcagattcagcgccagcaaggacgcctctgccaacgccggaatcctgctgatcagcggcctgcagtctgaggacgaggccgactactactgcatgatctggcactctggcgccagcgccgtgtttggcggaggcacaaaactgaccgtgctg

SEQ ID NO: 72 - DNA, 1773 bp, Artificial Sequence
  VHCH1 (20H4.9)-Heavy chain knob-VH (A5B7) (nucleotide sequence)
caggtgcagctgcagcagtggggagccggcctgctgaagcccagcgagacactgagcctgacctgcgccgtgtacggcggcagcttcagcggctactactggtcctggatccggcagagccccgagaagggcctggaatggatcggcgagatcaaccacggcggctacgtgacctacaaccccagcctggaaagcagagtgaccatcagcgtggacaccagcaagaaccagttcagcctgaagctgagcagcgtgacagccgccgacaccgccgtgtactactgcgccagagactacggccctggcaactacgactggtacttcgacctgtggggcagaggcaccctggtgacagtgtccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatctgggggcggaggttccggaggcggtggatctgaagtgcagctggtggaatctggcggcggactggtgcagcctggcagaagcctgagactgagctgtgccgccagcggctttaccgtgtccagctactggatgcactgggtccgacaggcccctggcaagggactggaatgggtcggattcatcagaaacaaggccaacggcggcaccaccgagtacgccgcctctgtgaagggccggttcaccatcagccgggacgacagcaagaacaccctgtacctgcagatgaacagcctgcgggccgaggacaccgccgtgtactactgcgccagagacagaggcctgcggttctacttcgactactggggccagggcaccaccgtgacagtctcttcc

SEQ ID NO: 73 - protein, 586 aa, Artificial Sequence
  VHCH1 (20H4.9)-Heavy chain hole-VL (A5B7)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSQAVLTQPASLSASPGASASLTCTLRRGINVGAYSIYWYQQKPGSPPQYLLRYKSDSDKQQGSGVSSRFSASKDASANAGILLISGLQSEDEADYYCMIWHSGASAVFGGGTKLTVL

SEQ ID NO: 74 - protein, 591 aa, Artificial Sequence
  VHCH1 (20H4.9)-Heavy chain knob-VH (A5B7)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLVESGGGLVQPGRSLRLSCAASGFTVSSYWMHWVRQAPGKGLEWVGFIRNKANGGTTEYAASVKGRFTISRDDSKNTLYLQMNSLRAEDTAVYYCARDRGLRFYFDYWGQGTTVTVSS

SEQ ID NO: 75 - DNA, 1773 bp, Artificial Sequence
  VHCH1 (20H4.9)-Heavy chain hole-VH (A5B7) (nucleotide sequence)
caggtgcagctgcagcagtggggagccggcctgctgaagcccagcgagacactgagcctgacctgcgccgtgtacggcggcagcttcagcggctactactggtcctggatccggcagagccccgagaagggcctggaatggatcggcgagatcaaccacggcggctacgtgacctacaaccccagcctggaaagcagagtgaccatcagcgtggacaccagcaagaaccagttcagcctgaagctgagcagcgtgacagccgccgacaccgccgtgtactactgcgccagagactacggccctggcaactacgactggtacttcgacctgtggggcagaggcaccctggtgacagtgtccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccggcggcggaggttccggaggcggaggatccgaagtgcagctggtggaatctggcggcggactggtgcagcctggcagaagcctgagactgagctgtgccgccagcggctttaccgtgtccagctactggatgcactgggtccgacaggcccctggcaagggactggaatgggtcggattcatcagaaacaaggccaacggcggcaccaccgagtacgccgcctctgtgaagggccggttcaccatcagccgggacgacagcaagaacaccctgtacctgcagatgaacagcctgcgggccgaggacaccgccgtgtactactgcgccagagacagaggcctgcggttctacttcgactactggggccagggcaccaccgtgacagtctcttcc

SEQ ID NO: 76 - DNA, 1758 bp, Artificial Sequence
  VHCH1 (20H4.9)-Heavy chain knob-VL (A5B7) (nucleotide sequence)
caggtgcagctgcagcagtggggagccggcctgctgaagcccagcgagacactgagcctgacctgcgccgtgtacggcggcagcttcagcggctactactggtcctggatccggcagagccccgagaagggcctggaatggatcggcgagatcaaccacggcggctacgtgacctacaaccccagcctggaaagcagagtgaccatcagcgtggacaccagcaagaaccagttcagcctgaagctgagcagcgtgacagccgccgacaccgccgtgtactactgcgccagagactacggccctggcaactacgactggtacttcgacctgtggggcagaggcaccctggtgacagtgtccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatctgggggcggaggttccggaggcggtggatctcaggccgtgctgacacagcctgccagcctgtctgcttctcctggcgcctctgcctccctgacctgcacactgagaagaggcatcaacgtgggcgcctacagcatctactggtatcagcagaagcccggcagcccccctcagtacctgctgagatacaagagcgacagcgacaagcagcagggcagcggcgtgtccagcagattcagcgccagcaaggacgcctctgccaacgccggaatcctgctgatcagcggcctgcagtctgaggacgaggccgactactactgcatgatctggcactctggcgccagcgccgtgtttggcggaggcacaaaactgaccgtgctg

SEQ ID NO: 77 - protein, 591 aa, Artificial Sequence
  VHCH1 (20H4.9)-Heavy chain hole-VH (A5B7)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSEVQLVESGGGLVQPGRSLRLSCAASGFTVSSYWMHWVRQAPGKGLEWVGFIRNKANGGTTEYAASVKGRFTISRDDSKNTLYLQMNSLRAEDTAVYYCARDRGLRFYFDYWGQGTTVTVSS

SEQ ID NO: 78 - protein, 586 aa, Artificial Sequence
  VHCH1 (20H4.9)-Heavy chain knob-VL (A5B7)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQAVLTQPASLSASPGASASLTCTLRRGINVGAYSIYWYQQKPGSPPQYLLRYKSDSDKQQGSGVSSRFSASKDASANAGILLISGLQSEDEADYYCMIWHSGASAVFGGGTKLTVL

SEQ ID NO: 79 - DNA, 2448 bp, Artificial Sequence
  VHCH1-VHCH1 (20H4.9)-Heavy chain hole-VL(T84.66-LCHA) (nucleotide sequence)
caggtgcagctgcagcagtggggagccggcctgctgaagcccagcgagacactgagcctgacctgcgccgtgtacggcggcagcttcagcggctactactggtcctggatccggcagagccccgagaagggcctggaatggatcggcgagatcaaccacggcggctacgtgacctacaaccccagcctggaaagcagagtgaccatcagcgtggacaccagcaagaaccagttcagcctgaagctgagcagcgtgacagccgccgacaccgccgtgtactactgcgccagagactacggccctggcaactacgactggtacttcgacctgtggggcagaggcaccctggtgacagtgtccagcgcttctaccaagggccccagcgtgttccctctggcccctagcagcaagagcacatctggcggaacagccgccctgggctgcctcgtgaaggactactttcccgagcccgtgacagtgtcctggaactctggcgccctgacaagcggcgtgcacacctttccagccgtgctgcagagcagcggcctgtactctctgagcagcgtcgtgactgtgcccagcagcagcctgggaacccagacctacatctgcaacgtgaaccacaagcccagcaacaccaaggtggacaagaaggtggaacccaagagctgcgacggcggaggcggatctggcggcggaggatcccaggtgcagctgcagcagtggggagccggcctgctgaagcccagcgagacactgagcctgacctgcgccgtgtacggcggcagcttcagcggctactactggtcctggatccggcagagccccgagaagggcctggaatggatcggcgagatcaaccacggcggctacgtgacctacaaccccagcctggaaagcagagtgaccatcagcgtggacaccagcaagaaccagttcagcctgaagctgagcagcgtgacagccgccgacaccgccgtgtactactgcgccagagactacggccctggcaactacgactggtacttcgacctgtggggcagaggcaccctggtgacagtgtccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccggcggcggaggttccggaggcggaggatccgagatcgtgctgacccagagccctgccaccctgtcactgtctccaggcgagagagccaccctgagctgtagagccggcgagagcgtggacatcttcggcgtgggatttctgcactggtatcagcagaagcccggccaggcccccagactgctgatctacagagccagcaaccgggccacaggcatccccgccagattttctggctctggcagcggcaccgacttcaccctgacaatcagcagcctggaacccgaggacttcgccgtgtactactgccagcagaccaacgaggacccctacacctttggccagggcaccaagctggaaatcaag

SEQ ID NO: 80 - DNA, 2478 bp, Artificial Sequence
  VHCH1-VHCH1 (20H4.9)-Heavy chain knob-VH(T84.66-LCHA) (nucleotide sequence)
caggtgcagctgcagcagtggggagccggcctgctgaagcccagcgagacactgagcctgacctgcgccgtgtacggcggcagcttcagcggctactactggtcctggatccggcagagccccgagaagggcctggaatggatcggcgagatcaaccacggcggctacgtgacctacaaccccagcctggaaagcagagtgaccatcagcgtggacaccagcaagaaccagttcagcctgaagctgagcagcgtgacagccgccgacaccgccgtgtactactgcgccagagactacggccctggcaactacgactggtacttcgacctgtggggcagaggcaccctggtgacagtgtccagcgcttctaccaagggccccagcgtgttccctctggcccctagcagcaagagcacatctggcggaacagccgccctgggctgcctcgtgaaggactactttcccgagcccgtgacagtgtcctggaactctggcgccctgacaagcggcgtgcacacctttccagccgtgctgcagagcagcggcctgtactctctgagcagcgtcgtgactgtgcccagcagcagcctgggaacccagacctacatctgcaacgtgaaccacaagcccagcaacaccaaggtggacaagaaggtggaacccaagagctgcgacggcggaggcggatctggcggcggaggatcccaggtgcagctgcagcagtggggagccggcctgctgaagcccagcgagacactgagcctgacctgcgccgtgtacggcggcagcttcagcggctactactggtcctggatccggcagagccccgagaagggcctggaatggatcggcgagatcaaccacggcggctacgtgacctacaaccccagcctggaaagcagagtgaccatcagcgtggacaccagcaagaaccagttcagcctgaagctgagcagcgtgacagccgccgacaccgccgtgtactactgcgccagagactacggccctggcaactacgactggtacttcgacctgtggggcagaggcaccctggtgacagtgtccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatctgggggcggaggttccggaggcggtggatctcaggtgcagctggtgcagtctggcgccgaagtgaagaaacccggcagcagcgtgaaggtgtcctgcaaggccagcggcttcaacatcaaggacacctacatgcactgggtgcgccaggcccctggacagggactggaatggatgggcagaatcgaccccgccaacggcaacagcaaatacgtgcccaagttccagggcagagtgaccatcaccgccgacaccagcacctccaccgcctacatggaactgagcagcctgcggagcgaggacaccgccgtgtactactgtgcccccttcggctactacgtgtccgactacgccatggcctattggggccagggcacactcgtgaccgtgtcctct

SEQ ID NO: 81 - protein, 816 aa, Artificial Sequence
  VHCH1-VHCH1 (20H4.9)-Heavy chain hole-VL (T84.66-LCHA)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSQVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSEIVLTQSPATLSLSPGERATLSCRAGESVDIFGVGFLHWYQQKPGQAPRLLIYRASNRATGIPARFSGSGSGTDFTLTISSLEPEDFAVYYCQQTNEDPYTFGQGTKLEIK

SEQ ID NO: 82 - protein, 826 aa, Artificial Sequence
  VHCH1-VHCH1 (20H4.9)-Heavy chain knob-VH (T84.66-LCHA)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSQVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVQSGAEVKKPGSSVKVSCKASGFNIKDTYMHWVRQAPGQGLEWMGRIDPANGNSKYVPKFQGRVTITADTSTSTAYMELSSLRSEDTAVYYCAPFGYYVSDYAMAYWGQGTLVTVSS

SEQ ID NO: 83 - DNA, 2478 bp, Artificial Sequence
  VHCH1-VHCH1 (20H4.9)-Heavy chain hole-VH (T84.66-LCHA) (nucleotide sequence)
caggtgcagctgcagcagtggggagccggcctgctgaagcccagcgagacactgagcctgacctgcgccgtgtacggcggcagcttcagcggctactactggtcctggatccggcagagccccgagaagggcctggaatggatcggcgagatcaaccacggcggctacgtgacctacaaccccagcctggaaagcagagtgaccatcagcgtggacaccagcaagaaccagttcagcctgaagctgagcagcgtgacagccgccgacaccgccgtgtactactgcgccagagactacggccctggcaactacgactggtacttcgacctgtggggcagaggcaccctggtgacagtgtccagcgcttccacaaagggccccagcgtgttccctctggcccctagcagcaagagcacatctggcggaacagccgccctgggctgcctcgtgaaggactactttcccgagcccgtgacagtgtcctggaactctggcgccctgacaagcggcgtgcacacctttccagccgtgctgcagagcagcggcctgtactctctgtccagcgtcgtgactgtgcccagcagcagcctgggcacccagacctacatctgcaacgtgaaccacaagcccagcaacaccaaggtggacaagaaggtggaacccaagagctgcgacggcggaggcggatctggcggcggaggatcccaggtgcagctgcagcagtggggagccggcctgctgaagcccagcgagacactgagcctgacctgcgccgtgtacggcggcagcttcagcggctactactggtcctggatccggcagagccccgagaagggcctggaatggatcggcgagatcaaccacggcggctacgtgacctacaaccccagcctggaaagcagagtgaccatcagcgtggacaccagcaagaaccagttcagcctgaagctgagcagcgtgacagccgccgacaccgccgtgtactactgcgccagagactacggccctggcaactacgactggtacttcgacctgtggggcagaggcaccctggtgacagtgtccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccggcggcggaggttccggaggcggaggatcccaggtgcagctggtgcagtctggcgccgaagtgaagaaacccggcagcagcgtgaaggtgtcctgcaaggccagcggcttcaacatcaaggacacctacatgcactgggtgcgccaggcccctggacagggactggaatggatgggcagaatcgaccccgccaacggcaacagcaaatacgtgcccaagttccagggcagagtgaccatcaccgccgacaccagcacctccaccgcctacatggaactgagcagcctgcggagcgaggacaccgccgtgtactactgtgcccccttcggctactacgtgtccgactacgccatggcctattggggccagggcacactcgtgaccgtgtcctct

SEQ ID NO: 84 - DNA, 2448 bp, Artificial Sequence
  VHCH1-VHCH1 (20H4.9)-Heavy chain knob-VL (T84.66-LCHA) (nucleotide sequence)
caggtgcagctgcagcagtggggagccggcctgctgaagcccagcgagacactgagcctgacctgcgccgtgtacggcggcagcttcagcggctactactggtcctggatccggcagagccccgagaagggcctggaatggatcggcgagatcaaccacggcggctacgtgacctacaaccccagcctggaaagcagagtgaccatcagcgtggacaccagcaagaaccagttcagcctgaagctgagcagcgtgacagccgccgacaccgccgtgtactactgcgccagagactacggccctggcaactacgactggtacttcgacctgtggggcagaggcaccctggtgacagtgtccagcgcttccacaaagggccccagcgtgttccctctggcccctagcagcaagagcacatctggcggaacagccgccctgggctgcctcgtgaaggactactttcccgagcccgtgacagtgtcctggaactctggcgccctgacaagcggcgtgcacacctttccagccgtgctgcagagcagcggcctgtactctctgtccagcgtcgtgactgtgcccagcagcagcctgggcacccagacctacatctgcaacgtgaaccacaagcccagcaacaccaaggtggacaagaaggtggaacccaagagctgcgacggcggaggcggatctggcggcggaggatcccaggtgcagctgcagcagtggggagccggcctgctgaagcccagcgagacactgagcctgacctgcgccgtgtacggcggcagcttcagcggctactactggtcctggatccggcagagccccgagaagggcctggaatggatcggcgagatcaaccacggcggctacgtgacctacaaccccagcctggaaagcagagtgaccatcagcgtggacaccagcaagaaccagttcagcctgaagctgagcagcgtgacagccgccgacaccgccgtgtactactgcgccagagactacggccctggcaactacgactggtacttcgacctgtggggcagaggcaccctggtgacagtgtccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatctgggggcggaggttccggaggcggtggatctgagatcgtgctgacccagagccctgccaccctgtcactgtctccaggcgagagagccaccctgagctgtagagccggcgagagcgtggacatcttcggcgtgggatttctgcactggtatcagcagaagcccggccaggcccccagactgctgatctacagagccagcaaccgggccacaggcatccccgccagattttctggctctggcagcggcaccgacttcaccctgacaatcagcagcctggaacccgaggacttcgccgtgtactactgccagcagaccaacgaggacccctacacctttggccagggcaccaagctggaaatcaag

SEQ ID NO: 85 - protein, 826 aa, Artificial Sequence
  VHCH1-VHCH1 (20H4.9)-Heavy chain hole-VH (T84.66-LCHA)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSQVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSQVQLVQSGAEVKKPGSSVKVSCKASGFNIKDTYMHWVRQAPGQGLEWMGRIDPANGNSKYVPKFQGRVTITADTSTSTAYMELSSLRSEDTAVYYCAPFGYYVSDYAMAYWGQGTLVTVSS

SEQ ID NO: 86 - protein, 816 aa, Artificial Sequence
  VHCH1-VHCH1 (20H4.9)-Heavy chain knob-VL (T84.66-LCHA)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSQVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPATLSLSPGERATLSCRAGESVDIFGVGFLHWYQQKPGQAPRLLIYRASNRATGIPARFSGSGSGTDFTLTISSLEPEDFAVYYCQQTNEDPYTFGQGTKLEIK

SEQ ID NO: 87 - DNA, 2463 bp, Artificial Sequence
  VHCH1-VHCH1 (20H4.9)-Heavy chain hole-VL(A5B7) (nucleotide sequence)
caggtgcagctgcagcagtggggagccggcctgctgaagcccagcgagacactgagcctgacctgcgccgtgtacggcggcagcttcagcggctactactggtcctggatccggcagagccccgagaagggcctggaatggatcggcgagatcaaccacggcggctacgtgacctacaaccccagcctggaaagcagagtgaccatcagcgtggacaccagcaagaaccagttcagcctgaagctgagcagcgtgacagccgccgacaccgccgtgtactactgcgccagagactacggccctggcaactacgactggtacttcgacctgtggggcagaggcaccctggtgacagtgtccagcgcttctaccaagggccccagcgtgttccctctggcccctagcagcaagagcacatctggcggaacagccgccctgggctgcctcgtgaaggactactttcccgagcccgtgacagtgtcctggaactctggcgccctgacaagcggcgtgcacacctttccagccgtgctgcagagcagcggcctgtactctctgagcagcgtcgtgactgtgcccagcagcagcctgggaacccagacctacatctgcaacgtgaaccacaagcccagcaacaccaaggtggacaagaaggtggaacccaagagctgcgacggcggaggcggatctggcggcggaggatcccaggtgcagctgcagcagtggggagccggcctgctgaagcccagcgagacactgagcctgacctgcgccgtgtacggcggcagcttcagcggctactactggtcctggatccggcagagccccgagaagggcctggaatggatcggcgagatcaaccacggcggctacgtgacctacaaccccagcctggaaagcagagtgaccatcagcgtggacaccagcaagaaccagttcagcctgaagctgagcagcgtgacagccgccgacaccgccgtgtactactgcgccagagactacggccctggcaactacgactggtacttcgacctgtggggcagaggcaccctggtgacagtgtccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccggcggcggaggttccggaggcggaggatcccaggccgtgctgacacagcctgccagcctgtctgcttctcctggcgcctctgcctccctgacctgcacactgagaagaggcatcaacgtgggcgcctacagcatctactggtatcagcagaagcccggcagcccccctcagtacctgctgagatacaagagcgacagcgacaagcagcagggcagcggcgtgtccagcagattcagcgccagcaaggacgcctctgccaacgccggaatcctgctgatcagcggcctgcagtctgaggacgaggccgactactactgcatgatctggcactctggcgccagcgccgtgtttggcggaggcacaaaactgaccgtgctg

SEQ ID NO: 88 - DNA, 2478 bp, Artificial Sequence
  VHCH1-VHCH1 (20H4.9)-Heavy chain knob-VH(A5B7) (nucleotide sequence)
caggtgcagctgcagcagtggggagccggcctgctgaagcccagcgagacactgagcctgacctgcgccgtgtacggcggcagcttcagcggctactactggtcctggatccggcagagccccgagaagggcctggaatggatcggcgagatcaaccacggcggctacgtgacctacaaccccagcctggaaagcagagtgaccatcagcgtggacaccagcaagaaccagttcagcctgaagctgagcagcgtgacagccgccgacaccgccgtgtactactgcgccagagactacggccctggcaactacgactggtacttcgacctgtggggcagaggcaccctggtgacagtgtccagcgcttctaccaagggccccagcgtgttccctctggcccctagcagcaagagcacatctggcggaacagccgccctgggctgcctcgtgaaggactactttcccgagcccgtgacagtgtcctggaactctggcgccctgacaagcggcgtgcacacctttccagccgtgctgcagagcagcggcctgtactctctgagcagcgtcgtgactgtgcccagcagcagcctgggaacccagacctacatctgcaacgtgaaccacaagcccagcaacaccaaggtggacaagaaggtggaacccaagagctgcgacggcggaggcggatctggcggcggaggatcccaggtgcagctgcagcagtggggagccggcctgctgaagcccagcgagacactgagcctgacctgcgccgtgtacggcggcagcttcagcggctactactggtcctggatccggcagagccccgagaagggcctggaatggatcggcgagatcaaccacggcggctacgtgacctacaaccccagcctggaaagcagagtgaccatcagcgtggacaccagcaagaaccagttcagcctgaagctgagcagcgtgacagccgccgacaccgccgtgtactactgcgccagagactacggccctggcaactacgactggtacttcgacctgtggggcagaggcaccctggtgacagtgtccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatctgggggcggaggttccggaggcggtggatctgaagtgcagctggtggaatctggcggcggactggtgcagcctggcagaagcctgagactgagctgtgccgccagcggctttaccgtgtccagctactggatgcactgggtccgacaggcccctggcaagggactggaatgggtcggattcatcagaaacaaggccaacggcggcaccaccgagtacgccgcctctgtgaagggccggttcaccatcagccgggacgacagcaagaacaccctgtacctgcagatgaacagcctgcgggccgaggacaccgccgtgtactactgcgccagagacagaggcctgcggttctacttcgactactggggccagggcaccaccgtgacagtctcttcc

SEQ ID NO: 89 - protein, 821 aa, Artificial Sequence
  VHCH1-VHCH1 (20H4.9)-Heavy chain hole-VL (A5B7)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSQVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSQAVLTQPASLSASPGASASLTCTLRRGINVGAYSIYWYQQKPGSPPQYLLRYKSDSDKQQGSGVSSRFSASKDASANAGILLISGLQSEDEADYYCMIWHSGASAVFGGGTKLTVL

SEQ ID NO: 90 - protein, 826 aa, Artificial Sequence
  VHCH1-VHCH1 (20H4.9)-Heavy chain knob-VH (A5B7)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSQVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLVESGGGLVQPGRSLRLSCAASGFTVSSYWMHWVRQAPGKGLEWVGFIRNKANGGTTEYAASVKGRFTISRDDSKNTLYLQMNSLRAEDTAVYYCARDRGLRFYFDYWGQGTTVTVSS

SEQ ID NO: 91 - DNA, 2478 bp, Artificial Sequence
  VHCH1-VHCH1 (20H4.9)-Heavy chain hole-VH (A5B7) (nucleotide sequence)
caggtgcagctgcagcagtggggagccggcctgctgaagcccagcgagacactgagcctgacctgcgccgtgtacggcggcagcttcagcggctactactggtcctggatccggcagagccccgagaagggcctggaatggatcggcgagatcaaccacggcggctacgtgacctacaaccccagcctggaaagcagagtgaccatcagcgtggacaccagcaagaaccagttcagcctgaagctgagcagcgtgacagccgccgacaccgccgtgtactactgcgccagagactacggccctggcaactacgactggtacttcgacctgtggggcagaggcaccctggtgacagtgtccagcgcttccacaaagggccccagcgtgttccctctggcccctagcagcaagagcacatctggcggaacagccgccctgggctgcctcgtgaaggactactttcccgagcccgtgacagtgtcctggaactctggcgccctgacaagcggcgtgcacacctttccagccgtgctgcagagcagcggcctgtactctctgtccagcgtcgtgactgtgcccagcagcagcctgggcacccagacctacatctgcaacgtgaaccacaagcccagcaacaccaaggtggacaagaaggtggaacccaagagctgcgacggcggaggcggatctggcggcggaggatcccaggtgcagctgcagcagtggggagccggcctgctgaagcccagcgagacactgagcctgacctgcgccgtgtacggcggcagcttcagcggctactactggtcctggatccggcagagccccgagaagggcctggaatggatcggcgagatcaaccacggcggctacgtgacctacaaccccagcctggaaagcagagtgaccatcagcgtggacaccagcaagaaccagttcagcctgaagctgagcagcgtgacagccgccgacaccgccgtgtactactgcgccagagactacggccctggcaactacgactggtacttcgacctgtggggcagaggcaccctggtgacagtgtccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccggcggcggaggttccggaggcggaggatccgaagtgcagctggtggaatctggcggcggactggtgcagcctggcagaagcctgagactgagctgtgccgccagcggctttaccgtgtccagctactggatgcactgggtccgacaggcccctggcaagggactggaatgggtcggattcatcagaaacaaggccaacggcggcaccaccgagtacgccgcctctgtgaagggccggttcaccatcagccgggacgacagcaagaacaccctgtacctgcagatgaacagcctgcgggccgaggacaccgccgtgtactactgcgccagagacagaggcctgcggttctacttcgactactggggccagggcaccaccgtgacagtctcttcc

SEQ ID NO: 92 - DNA, 2463 bp, Artificial Sequence
  VHCH1-VHCH1 (20H4.9)-Heavy chain knob-VL (A5B7) (nucleotide sequence)
caggtgcagctgcagcagtggggagccggcctgctgaagcccagcgagacactgagcctgacctgcgccgtgtacggcggcagcttcagcggctactactggtcctggatccggcagagccccgagaagggcctggaatggatcggcgagatcaaccacggcggctacgtgacctacaaccccagcctggaaagcagagtgaccatcagcgtggacaccagcaagaaccagttcagcctgaagctgagcagcgtgacagccgccgacaccgccgtgtactactgcgccagagactacggccctggcaactacgactggtacttcgacctgtggggcagaggcaccctggtgacagtgtccagcgcttccacaaagggccccagcgtgttccctctggcccctagcagcaagagcacatctggcggaacagccgccctgggctgcctcgtgaaggactactttcccgagcccgtgacagtgtcctggaactctggcgccctgacaagcggcgtgcacacctttccagccgtgctgcagagcagcggcctgtactctctgtccagcgtcgtgactgtgcccagcagcagcctgggcacccagacctacatctgcaacgtgaaccacaagcccagcaacaccaaggtggacaagaaggtggaacccaagagctgcgacggcggaggcggatctggcggcggaggatcccaggtgcagctgcagcagtggggagccggcctgctgaagcccagcgagacactgagcctgacctgcgccgtgtacggcggcagcttcagcggctactactggtcctggatccggcagagccccgagaagggcctggaatggatcggcgagatcaaccacggcggctacgtgacctacaaccccagcctggaaagcagagtgaccatcagcgtggacaccagcaagaaccagttcagcctgaagctgagcagcgtgacagccgccgacaccgccgtgtactactgcgccagagactacggccctggcaactacgactggtacttcgacctgtggggcagaggcaccctggtgacagtgtccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatctgggggcggaggttccggaggcggtggatctcaggccgtgctgacacagcctgccagcctgtctgcttctcctggcgcctctgcctccctgacctgcacactgagaagaggcatcaacgtgggcgcctacagcatctactggtatcagcagaagcccggcagcccccctcagtacctgctgagatacaagagcgacagcgacaagcagcagggcagcggcgtgtccagcagattcagcgccagcaaggacgcctctgccaacgccggaatcctgctgatcagcggcctgcagtctgaggacgaggccgactactactgcatgatctggcactctggcgccagcgccgtgtttggcggaggcacaaaactgaccgtgctg

SEQ ID NO: 93 - protein, 826 aa, Artificial Sequence
  VHCH1-VHCH1 (20H4.9)-Heavy chain hole-VH (A5B7)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSQVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSEVQLVESGGGLVQPGRSLRLSCAASGFTVSSYWMHWVRQAPGKGLEWVGFIRNKANGGTTEYAASVKGRFTISRDDSKNTLYLQMNSLRAEDTAVYYCARDRGLRFYFDYWGQGTTVTVSS

SEQ ID NO: 94 - protein, 821 aa, Artificial Sequence
  VHCH1-VHCH1 (20H4.9)-Heavy chain knob-VL (A5B7)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSQVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQAVLTQPASLSASPGASASLTCTLRRGINVGAYSIYWYQQKPGSPPQYLLRYKSDSDKQQGSGVSSRFSASKDASANAGILLISGLQSEDEADYYCMIWHSGASAVFGGGTKLTVL

SEQ ID NO: 95 - protein, 760 aa, Homo sapiens
MKTWVKIVFGVATSAVLALLVMCIVLRPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 96 - protein, 748 aa, Artificial Sequence
  hu FAP ectodomain+poly-lys-tag+his6-tag
RPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSDGKKKKKKGHHHHHH

SEQ ID NO: 97 - protein, 761 aa, Mus musculus
MKTWLKTVFGVTTLAALALVVICIVLRPSRVYKPEGNTKRALTLKDILNGTFSYKTYFPNWISEQEYLHQSEDDNIVFYNIETRESYIILSNSTMKSVNATDYGLSPDRQFVYLESDYSKLWRYSYTATYYIYDLQNGEFVRGYELPRPIQYLCWSPVGSKLAYVYQNNIYLKQRPGDPPFQITYTGRENRIFNGIPDWVYEEEMLATKYALWWSPDGKFLAYVEFNDSDIPIIAYSYYGDGQYPRTINIPYPKAGAKNPVVRVFIVDTTYPHHVGPMEVPVPEMIASSDYYFSWLTWVSSERVCLQWLKRVQNVSVLSICDFREDWHAWECPKNQEHVEESRTGWAGGFFVSTPAFSQDATSYYKIFSDKDGYKHIHYIKDTVENAIQITSGKWEAIYIFRVTQDSLFYSSNEFEGYPGRRNIYRISIGNSPPSKKCVTCHLRKERCQYYTASFSYKAKYYALVCYGPGLPISTLHDGRTDQEIQVLEENKELENSLRNIQLPKVEIKKLKDGGLTFWYKMILPPQFDRSKKYPLLIQVYGGPCSQSVKSVFAVNWITYLASKEGIVIALVDGRGTAFQGDKFLHAVYRKLGVYEVEDQLTAVRKFIEMGFIDEERIAIWGWSYGGYVSSLALASGTGLFKCGIAVAPVSSWEYYASIYSERFMGLPTKDDNLEHYKNSTVMARAEYFRNVDYLLIHGTADDNVHFQNSAQIAKALVNAQVDFQAMWYSDQNHGISSGRSQNHLYTHMTHFLKQCFSLSD

SEQ ID NO: 98 - protein, 749 aa, Artificial Sequence
  Murine FAP ectodomain+poly-lys-tag+his6-tag
RPSRVYKPEGNTKRALTLKDILNGTFSYKTYFPNWISEQEYLHQSEDDNIVFYNIETRESYIILSNSTMKSVNATDYGLSPDRQFVYLESDYSKLWRYSYTATYYIYDLQNGEFVRGYELPRPIQYLCWSPVGSKLAYVYQNNIYLKQRPGDPPFQITYTGRENRIFNGIPDWVYEEEMLATKYALWWSPDGKFLAYVEFNDSDIPIIAYSYYGDGQYPRTINIPYPKAGAKNPVVRVFIVDTTYPHHVGPMEVPVPEMIASSDYYFSWLTWVSSERVCLQWLKRVQNVSVLSICDFREDWHAWECPKNQEHVEESRTGWAGGFFVSTPAFSQDATSYYKIFSDKDGYKHIHYIKDTVENAIQITSGKWEAIYIFRVTQDSLFYSSNEFEGYPGRRNIYRISIGNSPPSKKCVTCHLRKERCQYYTASFSYKAKYYALVCYGPGLPISTLHDGRTDQEIQVLEENKELENSLRNIQLPKVEIKKLKDGGLTFWYKMILPPQFDRSKKYPLLIQVYGGPCSQSVKSVFAVNWITYLASKEGIVIALVDGRGTAFQGDKFLHAVYRKLGVYEVEDQLTAVRKFIEMGFIDEERIAIWGWSYGGYVSSLALASGTGLFKCGIAVAPVSSWEYYASIYSERFMGLPTKDDNLEHYKNSTVMARAEYFRNVDYLLIHGTADDNVHFQNSAQIAKALVNAQVDFQAMWYSDQNHGILSGRSQNHLYTHMTHFLKQCFSLSDGKKKKKKGHHHHHH

SEQ ID NO: 99 - protein, 748 aa, Artificial Sequence
  Cynomolgus FAP ectodomain+poly-lys-tag+his6-tag
RPPRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPFVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEDYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSDGKKKKKKGHHHHHH

SEQ ID NO: 100 - protein, 702 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNKLSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 101 - protein, 2322 aa, Homo sapiens
MQSGPRPPLPAPGLALALTLTMLARLASAASFFGENHLEVPVATALTDIDLQLQFSTSQPEALLLLAAGPADHLLLQLYSGRLQVRLVLGQEELRLQTPAETLLSDSIPHTVVLTVVEGWATLSVDGFLNASSAVPGAPLEVPYGLFVGGTGTLGLPYLRGTSRPLRGCLHAATLNGRSLLRPLTPDVHEGCAEEFSASDDVALGFSGPHSLAAFPAWGTQDEGTLEFTLTTQSRQAPLAFQAGGRRGDFIYVDIFEGHLRAVVEKGQGTVLLHNSVPVADGQPHEVSVHINAHRLEISVDQYPTHTSNRGVLSYLEPRGSLLLGGLDAEASRHLQEHRLGLTPEATNASLLGCMEDLSVNGQRRGLREALLTRNMAAGCRLEEEEYEDDAYGHYEAFSTLAPEAWPAMELPEPCVPEPGLPPVFANFTQLLTISPLVVAEGGTAWLEWRHVQPTLDLMEAELRKSQVLFSVTRGARHGELELDIPGAQARKMFTLLDVVNRKARFIHDGSEDTSDQLVLEVSVTARVPMPSCLRRGQTYLLPIQVNPVNDPPHIIFPHGSLMVILEHTQKPLGPEVFQAYDPDSACEGLTFQVLGTSSGLPVERRDQPGEPATEFSCRELEAGSLVYVHRGGPAQDLTFRVSDGLQASPPATLKVVAIRPAIQIHRSTGLRLAQGSAMPILPANLSVETNAVGQDVSVLFRVTGALQFGELQKQGAGGVEGAEWWATQAFHQRDVEQGRVRYLSTDPQHHAYDTVENLALEVQVGQEILSNLSFPVTIQRATVWMLRLEPLHTQNTQQETLTTAHLEATLEEAGPSPPTFHYEVVQAPRKGNLQLQGTRLSDGQGFTQDDIQAGRVTYGATARASEAVEDTFRFRVTAPPYFSPLYTFPIHIGGDPDAPVLTNVLLVVPEGGEGVLSADHLFVKSLNSASYLYEVMERPRHGRLAWRGTQDKTTMVTSFTNEDLLRGRLVYQHDDSETTEDDIPFVATRQGESSGDMAWEEVRGVFRVAIQPVNDHAPVQTISRIFHVARGGRRLLTTDDVAFSDADSGFADAQLVLTRKDLLFGSIVAVDEPTRPIYRFTQEDLRKRRVLFVHSGADRGWIQLQVSDGQHQATALLEVQASEPYLRVANGSSLVVPQGGQGTIDTAVLHLDTNLDIRSGDEVHYHVTAGPRWGQLVRAGQPATAFSQQDLLDGAVLYSHNGSLSPRDTMAFSVEAGPVHTDATLQVTIALEGPLAPLKLVRHKKIYVFQGEAAEIRRDQLEAAQEAVPPADIVFSVKSPPSAGYLVMVSRGALADEPPSLDPVQSFSQEAVDTGRVLYLHSRPEAWSDAFSLDVASGLGAPLEGVLVELEVLPAAIPLEAQNFSVPEGGSLTLAPPLLRVSGPYFPTLLGLSLQVLEPPQHGALQKEDGPQARTLSAFSWRMVEEQLIRYVHDGSETLTDSFVLMANASEMDRQSHPVAFTVTVLPVNDQPPILTTNTGLQMWEGATAPIPAEALRSTDGDSGSEDLVYTIEQPSNGRVVLRGAPGTEVRSFTQAQLDGGLVLFSHRGTLDGGFRFRLSDGEHTSPGHFFRVTAQKQVLLSLKGSQTLTVCPGSVQPLSSQTLRASSSAGTDPQLLLYRVVRGPQLGRLFHAQQDSTGEALVNFTQAEVYAGNILYEHEMPPEPFWEAHDTLELQLSSPPARDVAATLAVAVSFEAACPQRPSHLWKNKGLWVPEGQRARITVAALDASNLLASVPSPQRSEHDVLFQVTQFPSRGQLLVSEEPLHAGQPHFLQSQLAAGQLVYAHGGGGTQQDGFHFRAHLQGPAGASVAGPQTSEAFAITVRDVNERPPQPQASVPLRLTRGSRAPISRAQLSVVDPDSAPGEIEYEVQRAPHNGFLSLVGGGLGPVTRFTQADVDSGRLAFVANGSSVAGIFQLSMSDGASPPLPMSLAVDILPSAIEVQLRAPLEVPQALGRSSLSQQQLRVVSDREEPEAAYRLIQGPQYGHLLVGGRPTSAFSQFQIDQGEVVFAFTNFSSSHDHFRVLALARGVNASAVVNVTVRALLHVWAGGPWPQGATLRLDPTVLDAGELANRTGSVPRFRLLEGPRHGRVVRVPRARTEPGGSQLVEQFTQQDLEDGRLGLEVGRPEGRAPGPAGDSLTLELWAQGVPPAVASLDFATEPYNAARPYSVALLSVPEAARTEAGKPESSTPTGEPGPMASSPEPAVAKGGFLSFLEANMFSVIIPMCLVLLLLALILPLLFYLRKRNKTGKHDVQVLTAKPRNGLAGDTETFRKVEPGQAIPLTAVPGQGPPPGGQPDPELLQFCRTPNPALKNGQYWV

SEQ ID NO: 102 - protein, 1210 aa, Homo sapiens [sequence omitted]

SEQ ID NO: 103 - protein, 556 aa, Homo sapiens [sequence omitted]

SEQ ID NO: 104 - protein, 297 aa, Homo sapiens
MTTPRNSVNGTFPAEPMKGPIAMQSGPKPLFRRMSSLVGPTQSFFMRESKTLGAVQIMNGLFHIALGGLLMIPAGIYAPICVTVWYPLWGGIMYIISGSLLAATEKNSRKCLVKGKMIMNSLSLFAAISGMILSIMDILNIKISHFLKMESLNFIRAHTPYINIYNCEPANPSEKNSPSTQYCYSIQSLFLGILSVMLIFAFFQELVIAGIVENEWKRTCSRPKSNIVLLSAEEKKEQTIEIKEEVVGLTETSSQPKNEEDIEIIPIQEEEEEETETNFPEPPQDQESSPIENDSSP

SEQ ID NO: 105 - protein, 364 aa, Homo sapiens
MPLLLLLPLLWAGALAMDPNFWLQVQESVTVQEGLCVLVPCTFFHPIPYYDKNSPVHGYWFREGAIISRDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGAIGGAGVTALLALCLCLIFFIVKTHRRKAARTAVGRNDTHPTTGSASPKHQKKSKLHGPTETSSCSGAAPTVEMDEELHYASLNFHGMNPSKDTSTEYSEVRTQ

SEQ ID NO: 106 - protein, 255 aa, Homo sapiens
MGNSCYNIVATLLLVLNFERTRSLQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 107 - protein, 256 aa, Mus musculus
MGNNCYNVVVIVLLLVGCEKVGAVQNSCDNCQPGTFCRKYNPVCKSCPPSTFSSIGGQPNCNICRVCAGYFRFKKFCSSTHNAECECIEGFHCLGPQCTRCEKDCRPGQELTKQGCKTCSLGTFNDQNGTGVCRPWTNCSLDGRSVLKTGTTEKDVVCGPPVVSFSPSTTISVTPEGGPGGHSLQVLTLFLALTSALLLALIFITLLFSVLKWIRKKFPHIFKQPFKKTTGAAQEEDACSCRCPQEEEGGGGGYEL

SEQ ID NO: 108 - protein, 254 aa, Macaca fascicularis
MGNSCYNIVATLLLVLNFERTRSLQDLCSNCPAGTFCDNNRSQICSPCPPNSFSSAGGQRTCDICRQCKGVFKTRKECSSTSNAECDCISGYHCLGAECSMCEQDCKQGQELTKKGCKDCCFGTFNDQKRGICRPWTNCSLDGKSVLVNGTKERDVVCGPSPADLSPGASSATPPAPAREPGHSPQIIFFLALTSTVVLFLLFFLVLRFSVVKRSRKKLLYIFKQPFMRPVQTTQEEDGCSCRFPEEEEGGCEL

SEQ ID NO: 109 - protein, 5 aa, Artificial sequence
  Peptide linker
GGGGS

SEQ ID NO: 110 - protein, 10 aa, Artificial sequence
  Peptide linker
GGGGSGGGGS

SEQ ID NO: 111 - protein, 10 aa, Artificial sequence
  Peptide linker
SGGGGSGGGG

SEQ ID NO: 112 - protein, 14 aa, Artificial sequence
  Peptide linker
GGGGSGGGGSGGGG

SEQ ID NO: 113 - protein, 10 aa, Artificial sequence
  Peptide linker
GSPGSSSSGS

SEQ ID NO: 114 - protein, 15 aa, Artificial sequence
  Peptide linker
GGGGSGGGGSGGGGS

SEQ ID NO: 115 - protein, 20 aa, Artificial sequence
  Peptide linker
GGGGSGGGGSGGGGSGGGGS

SEQ ID NO: 116 - protein, 8 aa, Artificial sequence
  Peptide linker
GSGSGSGS

SEQ ID NO: 117 - protein, 8 aa, Artificial sequence
  Peptide linker
GSGSGNGS

SEQ ID NO: 118 - protein, 8 aa, Artificial sequence
  Peptide linker
GGSGSGSG

SEQ ID NO: 119 - protein, 6 aa, Artificial sequence
  Peptide linker
GGSGSG

SEQ ID NO: 120 - protein, 4 aa, Artificial sequence
  Peptide linker
GGSG

SEQ ID NO: 121 - protein, 8 aa, Artificial sequence
  Peptide linker
GGSGNGSG

SEQ ID NO: 122 - protein, 8 aa, Artificial sequence
  Peptide linker
GGNGSGSG

SEQ ID NO: 123 - protein, 6 aa, Artificial sequence
  Peptide linker
GGNGSG

SEQ ID NO: 124 - protein, 451 aa, Artificial Sequence
  VHCH1(EE) 4-1BB(20H4.9)-Heavy chain knob
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 125 - protein, 440 aa, Artificial Sequence
  VLCH1 FAP (4B9)-Heavy chain hole
EIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 126 - protein, 216 aa, Artificial Sequence
  VLCL(RK)-Light chain 4-1BB (20H4.9)
EIVLTQSPATLSLSPGERATLSCRASQSVSSYLAWYQQKPGQAPRLLIYDASNRATGIPARFSGSGSGTDFTLTISSLEPEDFAVYYCQQRSNWPPALTFGGGTKVEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 127 - protein, 224 aa, Artificial Sequence
  VHCL-Light chain FAP(4B9)
EVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 128 - protein, 568 aa, Artificial Sequence
  VHCH1 (20H4.9)-Heavy chain hole-VL (DP47)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGQGTKVEIK

SEQ ID NO: 129 - protein, 585 aa, Artificial Sequence
  VHCH1 (20H4.9)-Heavy chain knob-VH (DP47)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGSGFDYWGQGTLVTVSS

SEQ ID NO: 130 - protein, 575 aa, Artificial Sequence
  VHCH1 (20H4.9)-Heavy chain hole-VH (DP47)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGSGFDYWGQGTLVTVSS

SEQ ID NO: 131 - protein, 578 aa, Artificial Sequence
  VHCH1 (20H4.9)-Heavy chain knob-VL (DP47)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGQGTKVEIK

SEQ ID NO: 132 - protein, 571 aa, Artificial Sequence
  VHCH1 (MU137-1)-Heavy chain Fc-DD-VL (28H1)
DVQLVESGGGLVQPGRSLKLSCAASGFIFSYFDMAWVRQAPTKGLEWVASISPSGDIPYYRDSVKGRFTVSRENAKSSLYLQMDSLRSEDTATYYCARRSYGGYSELDYWGQGVMVTVSSAKTTPPSVYPLAPGSAAQTNSMVTLGCLVKGYFPEPVTVTWNSGSLSSGVHTFPAVLQSDLYTLSSSVTVPSSTWPSQTVTCNVAHPASSTKVDKKIVPRDCGCKPCICTVPEVSSVFIFPPKPKDVLTITLTPKVTCVVVAISKDDPEVQFSWFVDDVEVHTAQTKPREEQINSTFRSVSELPIMHQDWLNGKEFKCRVNSAAFGAPIEKTISKTKGRPKAPQVYTIPPPKEQMAKDKVSLTCMITNFFPEDITVEWQWNGQPAENYDNTQPIMDTDGSYFVYSDLNVQKSNWEAGNTFTCSVLHEGLHNHHTEKSLSHSPGGGGGSGGGGSGGGGSGGGGSEIVLTQSPGTLSLSPGERATLSCRASQSVSRSYLAWYQQKPGQAPRLLIIGASTRATGIPDRFSGSGSGTDFTLTISRLEPEDFAVYYCQQGQVIPPTFGQGTKVEIK

SEQ ID NO: 133 - protein, 579 aa, Artificial Sequence
  VHCH1 (20H4.9)-Heavy chain Fc-KK-VH (28H1)
DVQLVESGGGLVQPGRSLKLSCAASGFIFSYFDMAWVRQAPTKGLEWVASISPSGDIPYYRDSVKGRFTVSRENAKSSLYLQMDSLRSEDTATYYCARRSYGGYSELDYWGQGVMVTVSSAKTTPPSVYPLAPGSAAQTNSMVTLGCLVKGYFPEPVTVTWNSGSLSSGVHTFPAVLQSDLYTLSSSVTVPSSTWPSQTVTCNVAHPASSTKVDKKIVPRDCGCKPCICTVPEVSSVFIFPPKPKDVLTITLTPKVTCVVVAISKDDPEVQFSWFVDDVEVHTAQTKPREEQINSTFRSVSELPIMHQDWLNGKEFKCRVNSAAFGAPIEKTISKTKGRPKAPQVYTIPPPKKQMAKDKVSLTCMITNFFPEDITVEWQWNGQPAENYKNTQPIMKTDGSYFVYSKLNVQKSNWEAGNTFTCSVLHEGLHNHHTEKSLSHSPGGGGGSGGGGSGGGGSGGGGSEVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSS

SEQ ID NO: 134 - protein, 214 aa, Artificial Sequence
  VLCL-Light chain (MU137-1)
DIQMTQSPASLSASLEEIVTITCQASQDIGNWLAWYHQKPGKSPQLLIYGTSSLADGVPSRFSGSSSGSQYSLKISRLQVEDIGIYYCLQAYGAPWTFGGGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 135 - protein, 579 aa, Artificial Sequence
  VHCH1 (MU137-1)-Heavy chain Fc-DD-VH (28H1)
DVQLVESGGGLVQPGRSLKLSCAASGFIFSYFDMAWVRQAPTKGLEWVASISPSGDIPYYRDSVKGRFTVSRENAKSSLYLQMDSLRSEDTATYYCARRSYGGYSELDYWGQGVMVTVSSAKTTPPSVYPLAPGSAAQTNSMVTLGCLVKGYFPEPVTVTWNSGSLSSGVHTFPAVLQSDLYTLSSSVTVPSSTWPSQTVTCNVAHPASSTKVDKKIVPRDCGCKPCICTVPEVSSVFIFPPKPKDVLTITLTPKVTCVVVAISKDDPEVQFSWFVDDVEVHTAQTKPREEQINSTFRSVSELPIMHQDWLNGKEFKCRVNSAAFGAPIEKTISKTKGRPKAPQVYTIPPPKEQMAKDKVSLTCMITNFFPEDITVEWQWNGQPAENYDNTQPIMDTDGSYFVYSDLNVQKSNWEAGNTFTCSVLHEGLHNHHTEKSLSHSPGGGGGSGGGGSGGGGSGGGGSEVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSS

SEQ ID NO: 136 - protein, 571 aa, Artificial Sequence
  VHCH1 (MU137-1)-Heavy chain Fc-KK-VL (28H1)
DVQLVESGGGLVQPGRSLKLSCAASGFIFSYFDMAWVRQAPTKGLEWVASISPSGDIPYYRDSVKGRFTVSRENAKSSLYLQMDSLRSEDTATYYCARRSYGGYSELDYWGQGVMVTVSSAKTTPPSVYPLAPGSAAQTNSMVTLGCLVKGYFPEPVTVTWNSGSLSSGVHTFPAVLQSDLYTLSSSVTVPSSTWPSQTVTCNVAHPASSTKVDKKIVPRDCGCKPCICTVPEVSSVFIFPPKPKDVLTITLTPKVTCVVVAISKDDPEVQFSWFVDDVEVHTAQTKPREEQINSTFRSVSELPIMHQDWLNGKEFKCRVNSAAFGAPIEKTISKTKGRPKAPQVYTIPPPKKQMAKDKVSLTCMITNFFPEDITVEWQWNGQPAENYKNTQPIMKTDGSYFVYSKLNVQKSNWEAGNTFTCSVLHEGLHNHHTEKSLSHSPGGGGGSGGGGSGGGGSGGGGSEIVLTQSPGTLSLSPGERATLSCRASQSVSRSYLAWYQQKPGQAPRLLIIGASTRATGIPDRFSGSGSGTDFTLTISRLEPEDFAVYYCQQGQVIPPTFGQGTKVEIK

SEQ ID NO: 137 - protein, 576 aa, Artificial Sequence
  VHCH1 (20H4.9)-Heavy chain hole-VL (A5B7) (G4S)2
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSQAVLTQPASLSASPGASASLTCTLRRGINVGAYSIYWYQQKPGSPPQYLLRYKSDSDKQQGSGVSSRFSASKDASANAGILLISGLQSEDEADYYCMIWHSGASAVFGGGTKLTVL

SEQ ID NO: 138 - protein, 581 aa, Artificial Sequence
  VHCH1 (20H4.9)-Heavy chain hole-VH (A5B7) (G4S)2
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSEVQLVESGGGLVQPGRSLRLSCAASGFTVSSYWMHWVRQAPGKGLEWVGFIRNKANGGTTEYAASVKGRFTISRDDSKNTLYLQMNSLRAEDTAVYYCARDRGLRFYFDYWGQGTTVTVSS

SEQ ID NO: 139 - protein, 582 aa, Artificial Sequence
  VHCH1 (20H4.9)-Heavy chain hole-VL (2B11)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSDIVMTQTPLSLSVTPGQPASISCKSSQSLETSTGTTYLNWYLQKPGQSPQLLIYRVSKRFSGVPDRFSGSGSGTDFTLKISRVEAEDVGVYYCLQLLEDPYTFGQGTKLEIK

SEQ ID NO: 140 - protein, 591 aa, Artificial Sequence
  VHCH1 (20H4.9)-Heavy chain knob-VH (2B11)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGPQLFDYWGQGTTVTVSS

SEQ ID NO: 141 - protein, 591 aa, Artificial Sequence
  VHCH1 (20H4.9)-Heavy chain hole-VH (2B11)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSQVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGPQLFDYWGQGTTVTVSS

SEQ ID NO: 142 - protein, 582 aa, Artificial Sequence
  VHCH1 (20H4.9)-Heavy chain knob-VL (2B11)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIVMTQTPLSLSVTPGQPASISCKSSQSLETSTGTTYLNWYLQKPGQSPQLLIYRVSKRFSGVPDRFSGSGSGTDFTLKISRVEAEDVGVYYCLQLLEDPYTFGQGTKLEIK

SEQ ID NO: 143 - protein, 582 aa, Artificial Sequence
  VHCH1 (20H4.9)-Heavy chain hole-VL (8B8-018)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSDIVMTQTPLSLSVTPGQPASISCKSSQSLENPNGNTYLNWYLQKPGQSPQLLIYRVSKRFSGVPDRFSGSGSGTDFTLKISRVEAEDVGVYYCLQLTHVPYTFGQGTKLEIK

SEQ ID NO: 144 - protein, 591 aa, Artificial Sequence
  VHCH1 (20H4.9)-Heavy chain knob-VH (8B8-018)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGSALFDYWGQGTTVTVSS

SEQ ID NO: 145 - protein, 591 aa, Artificial Sequence
  VHCH1 (20H4.9)-Heavy chain hole-VH (8B8-018)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSQVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGSALFDYWGQGTTVTVSS

SEQ ID NO: 146 - protein, 582 aa, Artificial Sequence
  VHCH1 (20H4.9)-Heavy chain knob-VL (8B8-018)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIVMTQTPLSLSVTPGQPASISCKSSQSLENPNGNTYLNWYLQKPGQSPQLLIYRVSKRFSGVPDRFSGSGSGTDFTLKISRVEAEDVGVYYCLQLTHVPYTFGQGTKLEIK

SEQ ID NO: 147 - protein, 817 aa, Artificial Sequence
  VHCH1-VHCH1 (20H4.9)-Heavy chain Fc hole-VL (2B11)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSQVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSDIVMTQTPLSLSVTPGQPASISCKSSQSLETSTGTTYLNWYLQKPGQSPQLLIYRVSKRFSGVPDRFSGSGSGTDFTLKISRVEAEDVGVYYCLQLLEDPYTFGQGTKLEIK

SEQ ID NO: 148 - protein, 826 aa, Artificial Sequence
  VHCH1-VHCH1 (20H4.9)-Heavy chain Fc knob-VH (2B11)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSQVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGPQLFDYWGQGTTVTVSS

SEQ ID NO: 149 - protein, 826 aa, Artificial Sequence
  VHCH1-VHCH1 (20H4.9)-Heavy chain hole-VH (2B11)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSQVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSQVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGPQLFDYWGQGTTVTVSS

SEQ ID NO: 150 - protein, 817 aa, Artificial Sequence
  VHCH1-VHCH1 (20H4.9)-Heavy chain knob-VL (2B11)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSQVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIVMTQTPLSLSVTPGQPASISCKSSQSLETSTGTTYLNWYLQKPGQSPQLLIYRVSKRFSGVPDRFSGSGSGTDFTLKISRVEAEDVGVYYCLQLLEDPYTFGQGTKLEIK

SEQ ID NO: 151 - protein, 817 aa, Artificial Sequence
  VHCH1-VHCH1 (20H4.9)-Heavy chain Fc hole-VL (8B8-018)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSQVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSDIVMTQTPLSLSVTPGQPASISCKSSQSLENPNGNTYLNWYLQKPGQSPQLLIYRVSKRFSGVPDRFSGSGSGTDFTLKISRVEAEDVGVYYCLQLTHVPYTFGQGTKLEIK

SEQ ID NO: 152 - protein, 826 aa, Artificial Sequence
  VHCH1-VHCH1 (20H4.9)-Heavy chain Fc knob-VH (8B8-018)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSQVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGSALFDYWGQGTTVTVSS

SEQ ID NO: 153 - protein, 826 aa, Artificial Sequence
  VHCH1-VHCH1 (20H4.9)-Heavy chain hole-VH (8B8-018)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSQVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSQVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGSALFDYWGQGTTVTVSS

SEQ ID NO: 154 - protein, 817 aa, Artificial Sequence
  VHCH1-VHCH1 (20H4.9)-Heavy chain knob-VL (8B8-018)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSQVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIVMTQTPLSLSVTPGQPASISCKSSQSLENPNGNTYLNWYLQKPGQSPQLLIYRVSKRFSGVPDRFSGSGSGTDFTLKISRVEAEDVGVYYCLQLTHVPYTFGQGTKLEIK

SEQ ID NO: 155 - protein, 5 aa, Artificial Sequence
  CD19 (8B8-2B11) CDR-H1
DYIMH

SEQ ID NO: 156 - protein, 17 aa, Artificial Sequence
  CD19 (8B8-2B11) CDR-H2
YINPYNDGSKYTEKFQG

SEQ ID NO: 157 - protein, 12 aa, Artificial Sequence
  CD19 (8B8-2B11) CDR-H3
GTYYYGPQLFDY

SEQ ID NO: 158 - protein, 16 aa, Artificial Sequence
  CD19 (8B8-2B11) CDR-L1
KSSQSLETSTGTTYLN

SEQ ID NO: 159 - protein, 7 aa, Artificial Sequence
  CD19 (8B8-2B11) CDR-L2
RVSKRFS

SEQ ID NO: 160 - protein, 9 aa, Artificial Sequence
  CD19 (8B8-2B11) CDR-L3
LQLLEDPYT

SEQ ID NO: 161 - protein, 121 aa, Artificial Sequence
  CD19 (8B8-2B11) VH
QVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGPQLFDYWGQGTTVTVSS

SEQ ID NO: 162 - protein, 112 aa, Artificial Sequence
  CD19 (8B8-2B11) VL
DIVMTQTPLSLSVTPGQPASISCKSSQSLETSTGTTYLNWYLQKPGQSPQLLIYRVSKRFSGVPDRFSGSGSGTDFTLKISRVEAEDVGVYYCLQLLEDPYTFGQGTKLEIK

SEQ ID NO: 163 - protein, 5 aa, Artificial Sequence
  CD19 (8B8-018) CDR-H1
DYIMH

SEQ ID NO: 164 - protein, 17 aa, Artificial Sequence
  CD19 (8B8-018) CDR-H2
YINPYNDGSKYTEKFQG

SEQ ID NO: 165 - protein, 12 aa, Artificial Sequence
  CD19 (8B8-018) CDR-H3
GTYYYGSALFDY

SEQ ID NO: 166 - protein, 16 aa, Artificial Sequence
  CD19 (8B8-018) CDR-L1
KSSQSLENPNGNTYLN

SEQ ID NO: 167 - protein, 7 aa, Artificial Sequence
  CD19 (8B8-018) CDR-L2
RVSKRFS

SEQ ID NO: 168 - protein, 9 aa, Artificial Sequence
  CD19 (8B8-018) CDR-L3
LQLTHVPYT

SEQ ID NO: 169 - protein, 121 aa, Artificial Sequence
  CD19 (8B8-018) VH
QVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGSALFDYWGQGTTVTVSS

SEQ ID NO: 170 - protein, 112 aa, Artificial Sequence
  CD19 (8B8-018) VL
DIVMTQTPLSLSVTPGQPASISCKSSQSLENPNGNTYLNWYLQKPGQSPQLLIYRVSKRFSGVPDRFSGSGSGTDFTLKISRVEAEDVGVYYCLQLTHVPYTFGQGTKLEIK

SEQ ID NO: 171 - protein, 5 aa, Artificial Sequence
  4-1BB (MU137-1) CDR-H1
YFDMA

SEQ ID NO: 172 - protein, 17 aa, Artificial Sequence
  4-1BB (MU137-1) CDR-H2
SISPSGDIPYYRDSVKG

SEQ ID NO: 173 - protein, 11 aa, Artificial Sequence
  4-1BB (MU137-1) CDR-H3
RSYGGYSELDY

SEQ ID NO: 174 - protein, 11 aa, Artificial Sequence
  4-1BB (MU137-1) CDR-L1
QASQDIGNWLA

SEQ ID NO: 175 - protein, 7 aa, Artificial Sequence
  4-1BB (MU137-1) CDR-L2
GTSSLAD

SEQ ID NO: 176 - protein, 9 aa, Artificial Sequence
  4-1BB (MU137-1) CDR-L3
LQAYGAPWT

SEQ ID NO: 177 - protein, 120 aa, Artificial Sequence
  4-1BB (MU137-1) VH
DVQLVESGGGLVQPGRSLKLSCAASGFIFSYFDMAWVRQAPTKGLEWVASISPSGDIPYYRDSVKGRFTVSRENAKSSLYLQMDSLRSEDTATYYCARRSYGGYSELDYWGQGVMVTVSS

SEQ ID NO: 178 - protein, 107 aa, Artificial Sequence
  4-1BB (MU137-1) VL
DIQMTQSPASLSASLEEIVTITCQASQDIGNWLAWYHQKPGKSPQLLIYGTSSLADGVPSRFSGSSSGSQYSLKISRLQVEDIGIYYCLQAYGAPWTFGGGTKLELK

SEQ ID NO: 179 - protein, 5 aa, Artificial Sequence
  CEA (A5B7P)- CDR-H1
DYYMN

SEQ ID NO: 180 - protein, 19 aa, Artificial Sequence
  CEA (A5B7P)- CDR-H2
FIGNKANGYTTEYSASVKG

SEQ ID NO: 181 - protein, 10 aa, Artificial Sequence
  CEA (A5B7P)- CDR-H3
DRGLRFYFDY

SEQ ID NO: 182 - protein, 10 aa, Artificial Sequence
  CEA (A5B7P)- CDR-L1
RASSSVTYIH

SEQ ID NO: 183 - protein, 7 aa, Artificial Sequence
  CEA (A5B7P)- CDR-L2
ATSNLAS

SEQ ID NO: 184 - protein, 9 aa, Artificial Sequence
  CEA (A5B7P)- CDR-L3
QHWSSKPPT

SEQ ID NO: 185 - protein, 121 aa, Artificial Sequence
  CEA (A5B7P) VH
EVKLVESGGGLVQPGGSLRLSCATSGFTFTDYYMNWVRQPPGKALEWLGFIGNKANGYTTEYSASVKGRFTISRDKSQSILYLQMNTLRAEDSATYYCTRDRGLRFYFDYWGQGTTLTVSS

SEQ ID NO: 186 - protein, 106 aa, Artificial Sequence
  CEA (A5B7P) VL
QTVLSQSPAILSASPGEKVTMTCRASSSVTYIHWYQQKPGSSPKSWIYATSNLASGVPARFSGSGSGTSYSLTISRVEAEDAATYYCQHWSSKPPTFGGGTKLEIK

SEQ ID NO: 187 - protein, 6 aa, Artificial Sequence
  CEA (431/26)- CDR-H1
SGYSWH

SEQ ID NO: 188 - protein, 16 aa, Artificial Sequence
  CEA (431/26)- CDR-H2
YIQYSGITNYNPSLKS

SEQ ID NO: 189 - protein, 11 aa, Artificial Sequence
  CEA (431/26)- CDR-H3
EDYDYHWYFDV

SEQ ID NO: 190 - protein, 10 aa, Artificial Sequence
  CEA (431/26)- CDR-L1
STSSSVSYMH

SEQ ID NO: 191 - protein, 7 aa, Artificial Sequence
  CEA (431/26)- CDR-L2
STSNLAS

SEQ ID NO: 192 - protein, 8 aa, Artificial Sequence
  CEA (431/26)- CDR-L3
HQWSSYPT

SEQ ID NO: 193 - protein, 120 aa, Artificial Sequence
  CEA (431/26) VH
QVQLQESGPGLVRPSQTLSLTCTVSGFTISSGYSWHWVRQPPGRGLEWIGYIQYSGITNYNPSLKSRVTMLVDTSKNQFSLRLSSVTAADTAVYYCAREDYDYHWYFDVWGQGSLVTVSS

SEQ ID NO: 194 - protein, 105 aa, Artificial Sequence
  CEA (431/26) VL
DIQMTQSPSSLSASVGDRVTITCSTSSSVSYMHWYQQKPGKAPKLLIYSTSNLASGVPSRFSGSGSGTDFTFTISSLQPEDIATYYCHQWSSYPTFGQGTKVEIK

SEQ ID NO: 195 - protein, 576 aa, Artificial Sequence
  VHCH1 (20H4.9)-Heavy chain hole-VL (A5B7P)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSQTVLSQSPAILSASPGEKVTMTCRASSSVTYIHWYQQKPGSSPKSWIYATSNLASGVPARFSGSGSGTSYSLTISRVEAEDAATYYCQHWSSKPPTFGGGTKLEIK

SEQ ID NO: 196 - protein, 591 aa, Artificial Sequence
  VHCH1 (20H4.9)-Heavy chain knob-VH (A5B7P)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVKLVESGGGLVQPGGSLRLSCATSGFTFTDYYMNWVRQPPGKALEWLGFIGNKANGYTTEYSASVKGRFTISRDKSQSILYLQMNTLRAEDSATYYCTRDRGLRFYFDYWGQGTTLTVSS

SEQ ID NO: 197 - protein, 591 aa, Artificial Sequence
  VHCH1 (20H4.9)-Heavy chain hole-VH (A5B7P)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSEVKLVESGGGLVQPGGSLRLSCATSGFTFTDYYMNWVRQPPGKALEWLGFIGNKANGYTTEYSASVKGRFTISRDKSQSILYLQMNTLRAEDSATYYCTRDRGLRFYFDYWGQGTTLTVSS

SEQ ID NO: 198 - protein, 576 aa, Artificial Sequence
  VHCH1 (20H4.9)-Heavy chain knob-VL (A5B7P)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQTVLSQSPAILSASPGEKVTMTCRASSSVTYIHWYQQKPGSSPKSWIYATSNLASGVPARFSGSGSGTSYSLTISRVEAEDAATYYCQHWSSKPPTFGGGTKLEIK

SEQ ID NO: 199 - protein, 575 aa, Artificial Sequence
  VHCH1 (20H4.9)-Heavy chain hole-VL (431/26)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSDIQMTQSPSSLSASVGDRVTITCSTSSSVSYMHWYQQKPGKAPKLLIYSTSNLASGVPSRFSGSGSGTDFTFTISSLQPEDIATYYCHQWSSYPTFGQGTKVEIK

SEQ ID NO: 200 - protein, 590 aa, Artificial Sequence
  VHCH1 (20H4.9)-Heavy chain knob-VH (431/26)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLQESGPGLVRPSQTLSLTCTVSGFTISSGYSWHWVRQPPGRGLEWIGYIQYSGITNYNPSLKSRVTMLVDTSKNQFSLRLSSVTAADTAVYYCAREDYDYHWYFDVWGQGSLVTVSS

SEQ ID NO: 201 - protein, 590 aa, Artificial Sequence
  VHCH1 (20H4.9)-Heavy chain hole-VH (431/26)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSQVQLQESGPGLVRPSQTLSLTCTVSGFTISSGYSWHWVRQPPGRGLEWIGYIQYSGITNYNPSLKSRVTMLVDTSKNQFSLRLSSVTAADTAVYYCAREDYDYHWYFDVWGQGSLVTVSS

SEQ ID NO: 202 - protein, 575 aa, Artificial Sequence
  VHCH1 (20H4.9)-Heavy chain knob-VL (431/26)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSLSASVGDRVTITCSTSSSVSYMHWYQQKPGKAPKLLIYSTSNLASGVPSRFSGSGSGTDFTFTISSLQPEDIATYYCHQWSSYPTFGQGTKVEIK

SEQ ID NO: 203 - protein, 811 aa, Artificial Sequence
  VHCH1-VHCH1 (20H4.9)-Heavy chain hole-VL (A5B7P)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSQVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSQTVLSQSPAILSASPGEKVTMTCRASSSVTYIHWYQQKPGSSPKSWIYATSNLASGVPARFSGSGSGTSYSLTISRVEAEDAATYYCQHWSSKPPTFGGGTKLEIK

SEQ ID NO: 204 - protein, 826 aa, Artificial Sequence
  VHCH1-VHCH1 (20H4.9)-Heavy chain knob-VH (A5B7P)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSQVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVKLVESGGGLVQPGGSLRLSCATSGFTFTDYYMNWVRQPPGKALEWLGFIGNKANGYTTEYSASVKGRFTISRDKSQSILYLQMNTLRAEDSATYYCTRDRGLRFYFDYWGQGTTLTVSS

SEQ ID NO: 205 - protein, 826 aa, Artificial Sequence
  VHCH1-VHCH1 (20H4.9)-Heavy chain hole-VH (A5B7P)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSQVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSEVKLVESGGGLVQPGGSLRLSCATSGFTFTDYYMNWVRQPPGKALEWLGFIGNKANGYTTEYSASVKGRFTISRDKSQSILYLQMNTLRAEDSATYYCTRDRGLRFYFDYWGQGTTLTVSS

SEQ ID NO: 206 - protein, 811 aa, Artificial Sequence
  VHCH1-VHCH1 (20H4.9)-Heavy chain knob-VL (A5B7 P)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSQVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQTVLSQSPAILSASPGEKVTMTCRASSSVTYIHWYQQKPGSSPKSWIYATSNLASGVPARFSGSGSGTSYSLTISRVEAEDAATYYCQHWSSKPPTFGGGTKLEIK

SEQ ID NO: 207 - protein, 810 aa, Artificial Sequence
  VHCH1-VHCH1 (20H4.9)-Heavy chain hole-VL (431/26)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSQVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSDIQMTQSPSSLSASVGDRVTITCSTSSSVSYMHWYQQKPGKAPKLLIYSTSNLASGVPSRFSGSGSGTDFTFTISSLQPEDIATYYCHQWSSYPTFGQGTKVEIK

SEQ ID NO: 208 - protein, 825 aa, Artificial Sequence
  VHCH1-VHCH1 (20H4.9)-Heavy chain knob-VH (431/26)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSQVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLQESGPGLVRPSQTLSLTCTVSGFTISSGYSWHWVRQPPGRGLEWIGYIQYSGITNYNPSLKSRVTMLVDTSKNQFSLRLSSVTAADTAVYYCAREDYDYHWYFDVWGQGSLVTVSS

SEQ ID NO: 209 - protein, 825 aa, Artificial Sequence
  VHCH1-VHCH1 (20H4.9)-Heavy chain hole-VH (431/26)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSQVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSQVQLQESGPGLVRPSQTLSLTCTVSGFTISSGYSWHWVRQPPGRGLEWIGYIQYSGITNYNPSLKSRVTMLVDTSKNQFSLRLSSVTAADTAVYYCAREDYDYHWYFDVWGQGSLVTVSS

SEQ ID NO: 210 - protein, 810 aa, Artificial Sequence
  VHCH1-VHCH1 (20H4.9)-Heavy chain knob-VL (431/26)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSQVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSLSASVGDRVTITCSTSSSVSYMHWYQQKPGKAPKLLIYSTSNLASGVPSRFSGSGSGTDFTFTISSLQPEDIATYYCHQWSSYPTFGQGTKVEIK

SEQ ID NO: 211 - protein, 698 aa, Artificial Sequence
  VHCH1 (20H4.9)-Heavy chain knob-VHCL (A5B7P)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVKLVESGGGLVQPGGSLRLSCATSGFTFTDYYMNWVRQPPGKALEWLGFIGNKANGYTTEYSASVKGRFTISRDKSQSILYLQMNTLRAEDSATYYCTRDRGLRFYFDYWGQGTTLTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 212 - protein, 451 aa, Artificial Sequence
  VHCH1 (20H4.9)-Heavy chain hole
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 213 - protein, 211 aa, Artificial Sequence
  VLCH1-Light chain (A5B7P)
QTVLSQSPAILSASPGEKVTMTCRASSSVTYIHWYQQKPGSSPKSWIYATSNLASGVPARFSGSGSGTSYSLTISRVEAEDAATYYCQHWSSKPPTFGGGTKLEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 214 - protein, 681 aa, Artificial Sequence
  VHCH1 (20H4.9)-Heavy chain knob-VLCH (A5B7P)
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQTVLSQSPAILSASPGEKVTMTCRASSSVTYIHWYQQKPGSSPKSWIYATSNLASGVPARFSGSGSGTSYSLTISRVEAEDAATYYCQHWSSKPPTFGGGTKLEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 215 - protein, 451 aa, Artificial Sequence; identical to SEQ ID NO: 212
  VHCH1 (20H4.9)-Heavy chain hole

SEQ ID NO: 216 - protein, 216 aa, Artificial Sequence; identical to SEQ ID NO: 126
  VLCL-Light chain (20H4.9) (RK mutations)

SEQ ID NO: 217 - protein, 228 aa, Artificial Sequence
  VHCL-Light chain (A5B7P)
EVKLVESGGGLVQPGGSLRLSCATSGFTFTDYYMNWVRQPPGKALEWLGFIGNKANGYTTEYSASVKGRFTISRDKSQSILYLQMNTLRAEDSATYYCTRDRGLRFYFDYWGQGTTLTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

The invention claimed is:

1. A bispecific antigen binding molecule, comprising:
   two or four antigen binding domains that are Fab fragments each capable of specific binding to 4-1BB;
   an IgG Fc domain composed of a first and a second subunit capable of stable association;
   a VH and VL domain capable of specific binding to Fibroblast Activation Protein (FAP), wherein the VH domain is connected via a peptide linker to the C-terminus of one of the two first and second subunits and wherein the VL domain is connected via a peptide linker to the C-terminus of the other of the first and second subunits; and
   wherein the two or four antigen binding domains capable of specific binding to 4-1BB comprise two heavy chain and two light chain variable regions, or four heavy chain and four light chain variable regions, respectively, wherein:
   (i) the heavy chain variable region ($V_H$4-1BB) comprises: (i) CDR-H1 comprising the amino acid sequence of SEQ ID NO:1, (ii) CDR-H2 comprising the amino acid sequence of SEQ ID NO:2, and (iii) CDR-H3 comprising the amino acid sequence of SEQ ID NO:3, and
   (ii) the light chain variable region ($V_L$4-1BB) comprises (iv) CDR-L1 comprising the amino acid sequence of SEQ ID NO:4, (v) CDR-L2 comprising the amino acid sequence of SEQ ID NO:5, and (vi) CDR-L3 comprising the amino acid sequence of SEQ ID NO:6.

2. The bispecific antigen binding molecule of claim 1, wherein the VH and VL domains capable of specific binding to Fibroblast Activation Protein (FAP) comprise:
   (a) a heavy chain variable region ($V_H$FAP) comprising (i) CDR-H1 comprising the amino acid sequence of SEQ ID NO:9, (ii)CDR-H2 comprising the amino acid sequence of SEQ ID NO:10, and (iii) CDR-H3 comprising the amino acid sequence of SEQ ID NO:11, and a light chain variable region ($V_L$FAP) comprising (iv) CDR-L1 comprising the amino acid sequence of SEQ ID NO:12, (v) CDR-L2 comprising the amino acid sequence of SEQ ID NO:13, and (vi) CDR-L3 comprising the amino acid sequence of SEQ ID NO:14, or
   (b) a heavy chain variable region ($V_H$FAP) comprising (i)CDR-H1 comprising the amino acid sequence of SEQ ID NO:15, (ii)CDR-H2 comprising the amino acid sequence of SEQ ID NO:16, and (iii) CDR-H3 comprising the amino acid sequence of SEQ ID NO:17, and a light chain variable region ($V_L$FAP) comprising (iv) CDR-L1 comprising the amino acid sequence of SEQ ID NO:18, (v) CDR-L2 comprising the amino acid sequence of SEQ ID NO:19, and (vi) CDR-L3 comprising the amino acid sequence of SEQ ID NO:20.

3. The bispecific antigen binding molecule of claim 2, wherein the VH and VL domains capable of specific binding to Fibroblast Activation Protein (FAP) comprise:
   (a) a heavy chain variable region ($V_H$FAP) comprising an amino acid sequence that is at least about 95% identical to the amino acid sequence of SEQ ID NO:21, and a light chain variable region ($V_L$FAP) comprising an amino acid sequence that is at least about 95% identical to the amino acid sequence of SEQ ID NO:22, or
   (b) a heavy chain variable region ($V_H$FAP) comprising an amino acid sequence that is at least about 95% identical to the amino acid sequence of SEQ ID NO:23, and a light chain variable region ($V_L$FAP) comprising an amino acid sequence that is at least about 95% identical to the amino acid sequence of SEQ ID NO:24.

4. The bispecific antigen binding molecule of claim 1, wherein the IgG Fc domain is an IgG1 Fc domain or an IgG4 Fc domain.

5. The bispecific antigen binding molecule of claim 1, wherein the Fc domain is a human IgG1 Fc domain comprising amino acid mutations L234A, L235A and P329G, numbering according to Kabat EU index.

6. The bispecific antigen binding molecule of claim 1, comprising:
   (a) two antigen binding domains capable of specific binding to 4-1BB,
   (b) VH and VL domains capable of specific binding to Fibroblast Activation Protein (FAP), and
   (c) an IgG Fc domain comprising one or more amino acid substitutions that reduces the binding affinity of the antigen binding molecule to an Fc receptor and/or effector function.

7. The bispecific antigen binding molecule of claim 1, comprising:
   (a) four antigen binding domains capable of specific binding to 4-1BB,
   (b) VH and VL domains capable of specific binding to Fibroblast Activation Protein (FAP) and
   (c) an IgG Fc domain comprising one or more amino acid substitutions that reduces the binding affinity of the antigen binding molecule to an Fc receptor and/or effector function.

8. A polynucleotide encoding the bispecific antigen binding molecule of claim 1.

9. A host cell comprising the polynucleotide of claim 8.

10. A method of producing a bispecific antigen binding molecule comprising culturing the host cell of claim 9 under conditions suitable for the expression of the bispecific antigen binding molecule.

11. A pharmaceutical composition comprising a bispecific antigen binding molecule of claim 1 and at least one pharmaceutically acceptable excipient.

12. A method of inhibiting the growth of tumor cells in an individual comprising administering to the individual an effective amount of the bispecific antigen binding molecule of claim 1, to inhibit the growth of the tumor cells.

13. A method of treating cancer or an infectious disease comprising administering to the individual a therapeutically effective amount of the bispecific antigen binding molecule of claim 1 sufficient to treat the cancer or infectious disease.

14. The method of claim 13, wherein the method comprises treating cancer.

15. The method of claim 14, wherein the bispecific antigen binding molecule is administered in combination with a chemotherapeutic agent, radiation therapy and/or other agents for use in cancer immunotherapy.

16. The bispecific antigen binding molecule of claim 2, wherein the VH and VL domains capable of specific binding to Fibroblast Activation Protein (FAP) comprise a heavy chain variable region ($V_H$FAP) comprising (i)CDR-H1 comprising the amino acid sequence of SEQ ID NO:15, (ii) CDR-H2 comprising the amino acid sequence of SEQ ID NO:16, and (iii)CDR-H3 comprising the amino acid sequence of SEQ ID NO:17, and a light chain variable region ($V_L$FAP) comprising (iv) CDR-L1 comprising the amino acid sequence of SEQ ID NO:18, (v) CDR-L2 comprising the amino acid sequence of SEQ ID NO:19, and (vi) CDR-L3 comprising the amino acid sequence of SEQ ID NO:20.

17. The bispecific antigen binding molecule of claim 3, wherein the VH and VL domains capable of specific binding to Fibroblast Activation Protein (FAP) comprise a heavy chain variable region ($V_H$FAP) comprising the amino acid sequence of SEQ ID NO:23, and a light chain variable region ($V_L$FAP) comprising the amino acid sequence of SEQ ID NO:24.

18. The bispecific antigen binding molecule of claim 1, comprising two light chains, each comprising the amino acid sequence of SEQ ID NO:46, a first heavy chain comprising the amino acid sequence of SEQ ID NO:49, and a second heavy chain comprising the amino acid sequence of SEQ ID NO:50.

19. The bispecific antigen binding molecule of claim 1, wherein the two or four antigen binding domains capable of specific binding to 4-1BB comprise a heavy chain variable region ($V_H$4-1BB) comprising the amino acid sequence of SEQ ID NO:7 and a light chain variable region (VL4-1BB) comprising the amino acid sequence of SEQ ID NO:8.

20. The bispecific antigen binding molecule of claim 1, comprising two light chains, each comprising the amino acid sequence of SEQ ID NO:46, a first heavy chain comprising the amino acid sequence of SEQ ID NO:44, and a second heavy chain comprising the amino acid sequence of SEQ ID NO:45.

21. The bispecific antigen binding molecule of claim 1, comprising four light chains, each comprising the amino acid sequence of SEQ ID NO:46, a first heavy chain comprising the amino acid sequence of SEQ ID NO:61, and a second heavy chain comprising the amino acid sequence of SEQ ID NO:62.

22. The bispecific antigen binding molecule of claim 1, comprising four light chains, each comprising the amino acid sequence of SEQ ID NO:46, a first heavy chain comprising the amino acid sequence of SEQ ID NO:57, and a second heavy chain comprising the amino acid sequence of SEQ ID NO:58.

* * * * *